(12) United States Patent
Angel et al.

(10) Patent No.: US 12,344,572 B2
(45) Date of Patent: *Jul. 1, 2025

(54) CATIONIC LIPIDS AND TRANSFECTION METHODS

(71) Applicant: Factor Bioscience Inc., Cambridge, MA (US)

(72) Inventors: Matthew Angel, Cambridge, MA (US); Franklin Kostas, Cambridge, MA (US); Christopher Rohde, Cambridge, MA (US)

(73) Assignee: Factor Bioscience Inc., Cambridge, MA (US)

( * ) Notice: Subject to any disclaimer, the term of this patent is extended or adjusted under 35 U.S.C. 154(b) by 515 days.

This patent is subject to a terminal disclaimer.

(21) Appl. No.: 16/920,556

(22) Filed: Jul. 3, 2020

(65) Prior Publication Data
US 2021/0009505 A1 Jan. 14, 2021

Related U.S. Application Data

(60) Provisional application No. 63/023,654, filed on May 12, 2020, provisional application No. 62/880,435, filed on Jul. 30, 2019, provisional application No. 62/870,245, filed on Jul. 3, 2019.

(51) Int. Cl.
*C07C 215/24* (2006.01)
*A61K 9/00* (2006.01)
*A61K 9/10* (2006.01)
*A61K 47/54* (2017.01)

(52) U.S. Cl.
CPC .......... *C07C 215/24* (2013.01); *A61K 9/0021* (2013.01); *A61K 9/10* (2013.01); *A61K 47/543* (2017.08)

(58) Field of Classification Search
None
See application file for complete search history.

(56) References Cited

U.S. PATENT DOCUMENTS

| | | | |
|---|---|---|---|
| 3,539,465 A | 11/1970 | Jensen et al. |
| 5,837,533 A | 11/1998 | Boutin |
| 5,843,780 A | 12/1998 | Thomson |
| 6,127,170 A | 10/2000 | Boutin |
| 6,379,965 B1 | 4/2002 | Boutin |
| 6,835,712 B1 | 12/2004 | Camilleri et al. |
| 7,145,039 B2 | 12/2006 | Chu et al. |
| 7,166,745 B1 | 1/2007 | Chu et al. |
| 7,173,154 B2 | 2/2007 | Chu et al. |
| 7,276,489 B2 | 10/2007 | Agrawal et al. |
| 7,323,594 B2 | 1/2008 | Chu et al. |
| 7,442,548 B2 | 10/2008 | Thomson et al. |
| 7,449,334 B2 | 11/2008 | Thomson et al. |
| 7,470,817 B2 | 12/2008 | Chu et al. |
| 7,479,573 B2 | 1/2009 | Chu et al. |
| 7,601,872 B2 | 10/2009 | Chu et al. |
| 7,621,606 B2 | 11/2009 | Page et al. |
| 7,682,828 B2 | 3/2010 | Jaenisch et al. |
| 7,687,266 B2 | 3/2010 | Chambers et al. |
| 7,812,000 B2 | 10/2010 | Agrawal et al. |
| 7,915,450 B2 | 3/2011 | Chu et al. |
| 8,048,675 B1 | 11/2011 | Irion |
| 8,048,999 B2 | 11/2011 | Yamanaka et al. |
| 8,058,065 B2 | 11/2011 | Yamanaka et al. |
| 8,071,369 B2 | 12/2011 | Jaenisch et al. |
| 8,129,187 B2 | 3/2012 | Yamanaka et al. |
| 8,129,348 B2 | 3/2012 | Besman et al. |
| 8,158,827 B2 | 4/2012 | Chu et al. |
| 8,202,850 B2 | 6/2012 | Agrawal et al. |
| 8,278,036 B2 | 10/2012 | Kariko et al. |
| 8,420,782 B2 | 4/2013 | Bonas et al. |
| 8,440,431 B2 | 5/2013 | Voytas et al. |
| 8,440,432 B2 | 5/2013 | Voytas et al. |
| 8,450,471 B2 | 5/2013 | Voytas et al. |
| 8,470,973 B2 | 6/2013 | Bonas et al. |
| 8,497,124 B2 | 7/2013 | Angel et al. |
| 8,586,526 B2 | 11/2013 | Gregory et al. |
| 8,685,737 B2 | 4/2014 | Serber et al. |
| 8,691,966 B2 | 4/2014 | Kariko et al. |
| 8,710,200 B2 | 4/2014 | Schrum et al. |
| 8,716,465 B2 | 5/2014 | Rossi et al. |
| 8,748,089 B2 | 6/2014 | Kariko et al. |
| 8,785,200 B2 | 7/2014 | Chu et al. |
| 8,802,438 B2 | 8/2014 | Rossi et al. |
| 8,822,663 B2 | 9/2014 | Schrum et al. |
| 8,835,108 B2 | 9/2014 | Kariko et al. |
| 8,883,506 B2 | 11/2014 | Rossi et al. |
| 9,127,248 B2 | 9/2015 | Angel et al. |
| 9,358,300 B2 | 6/2016 | Chu et al. |
| 9,376,669 B2 | 6/2016 | Angel et al. |

(Continued)

FOREIGN PATENT DOCUMENTS

CN 101200758 6/2008
EP 2241572 A2 10/2010

(Continued)

OTHER PUBLICATIONS

International Preliminary Report on Patentability dated Dec. 28, 2021 for International Application No. PCT/US2020/040813.
International Search Report and Written Opinion dated Aug. 28, 2020 for International Application No. PCT/US2020/040813.
U.S. Appl. No. 16/930,901 Non-Final Office Action dated Sep. 22, 2021.
Akinc, et al., "A combinatorial library of lipid-like materials for delivery of RNAi therapeutics," Nature Biotechnology, 26(5): May 2008, pp. 561-569.
Alabi, et al., "A combinatorial library of lipid-like materials for delivery of RNAi therapeutics," Nat Biotechnol., 26(5), May 2008, pp. 561-569.
Albumax I product insert, Invitrogen Corporation, 1 page (2001).

(Continued)

*Primary Examiner* — Katherine Peebles
(74) *Attorney, Agent, or Firm* — Wilson Sonsini Goodrich & Rosati

(57) ABSTRACT

The present invention relates in part to novel cationic lipids and their use, e.g., in delivering nucleic acids to cells.

11 Claims, 22 Drawing Sheets

Specification includes a Sequence Listing.

(56) References Cited

U.S. PATENT DOCUMENTS

| | | |
|---|---|---|
| 9,399,761 B2 | 7/2016 | Angel et al. |
| 9,422,577 B2 | 8/2016 | Angel et al. |
| 9,447,395 B2 | 9/2016 | Angel et al. |
| 9,464,285 B2 | 10/2016 | Angel et al. |
| 9,487,768 B2 | 11/2016 | Angel et al. |
| 9,562,218 B2 | 2/2017 | Angel et al. |
| 9,597,357 B2 | 3/2017 | Gregory et al. |
| 9,605,277 B2 | 3/2017 | Angel et al. |
| 9,605,278 B2 | 3/2017 | Angel et al. |
| 9,636,302 B2 | 5/2017 | Constien et al. |
| 9,657,282 B2 | 5/2017 | Angel et al. |
| 9,695,401 B2 | 7/2017 | Angel et al. |
| 9,758,797 B2 | 9/2017 | Angel et al. |
| 9,770,489 B2 | 9/2017 | Angel et al. |
| 9,879,228 B2 | 1/2018 | Angel et al. |
| 9,969,983 B2 | 5/2018 | Angel et al. |
| 10,124,042 B2 | 11/2018 | Angel et al. |
| 10,131,882 B2 | 11/2018 | Angel et al. |
| 10,137,206 B2 | 11/2018 | Angel et al. |
| 10,195,280 B2 | 2/2019 | de Mollerat du Jeu et al. |
| 10,301,599 B2 | 5/2019 | Angel et al. |
| 10,350,304 B2 | 7/2019 | Angel et al. |
| 10,363,321 B2 | 7/2019 | Angel et al. |
| 10,501,404 B1 | 12/2019 | Angel et al. |
| 10,556,855 B1 | 2/2020 | Angel et al. |
| 10,611,722 B1 | 4/2020 | Angel et al. |
| 10,752,576 B1 | 8/2020 | Angel et al. |
| 11,242,311 B2 | 2/2022 | Angel et al. |
| 11,814,333 B2 | 11/2023 | Angel et al. |
| 2003/0009148 A1 | 1/2003 | Hayakawa |
| 2003/0083272 A1 | 5/2003 | Wiederholt et al. |
| 2003/0228658 A1 | 12/2003 | Shu et al. |
| 2005/0053588 A1 | 3/2005 | Yin |
| 2005/0130144 A1 | 6/2005 | Nakatsuji et al. |
| 2005/0192357 A1 | 9/2005 | Arai et al. |
| 2005/0272634 A1 | 12/2005 | Bahlmann et al. |
| 2007/0134796 A1 | 6/2007 | Holmes et al. |
| 2008/0009785 A1 | 1/2008 | Mikszta et al. |
| 2008/0213377 A1 | 9/2008 | Bhatia et al. |
| 2008/0233610 A1 | 9/2008 | Thomson et al. |
| 2008/0260706 A1 | 10/2008 | Rabinovich et al. |
| 2009/0029465 A1 | 1/2009 | Thomson et al. |
| 2009/0093433 A1 | 4/2009 | Woolf et al. |
| 2009/0275128 A1 | 11/2009 | Thomson et al. |
| 2009/0286852 A1 | 11/2009 | Kariko et al. |
| 2010/0003757 A1 | 1/2010 | Mack et al. |
| 2010/0047261 A1 | 2/2010 | Hoerr et al. |
| 2010/0075421 A1 | 3/2010 | Yamanka et al. |
| 2010/0076057 A1 | 3/2010 | Sontheimer et al. |
| 2010/0120079 A1 | 5/2010 | Page et al. |
| 2010/0144031 A1 | 6/2010 | Jaenisch et al. |
| 2010/0167286 A1 | 7/2010 | Reijo Pera et al. |
| 2010/0168000 A1 | 7/2010 | Kiessling et al. |
| 2010/0172882 A1 | 7/2010 | Glazer et al. |
| 2010/0184033 A1 | 7/2010 | West et al. |
| 2010/0184227 A1 | 7/2010 | Thomson et al. |
| 2010/0221829 A1 | 9/2010 | Amit et al. |
| 2010/0233804 A1 | 9/2010 | Zhou et al. |
| 2010/0267141 A1 | 10/2010 | Shi et al. |
| 2010/0272695 A1 | 10/2010 | Agulnick et al. |
| 2010/0273220 A1 | 10/2010 | Yanki et al. |
| 2010/0304481 A1 | 12/2010 | Thomson et al. |
| 2010/0311171 A1 | 12/2010 | Nakanishi et al. |
| 2010/0317104 A1 | 12/2010 | Elefanty et al. |
| 2011/0045001 A1 | 2/2011 | Klosel et al. |
| 2011/0065103 A1 | 3/2011 | Sahin et al. |
| 2011/0076678 A1 | 3/2011 | Jaenisch et al. |
| 2011/0104125 A1 | 5/2011 | Yu |
| 2011/0110899 A1 | 5/2011 | Shi et al. |
| 2011/0143397 A1 | 6/2011 | Kariko et al. |
| 2011/0143436 A1 | 6/2011 | Dahl et al. |
| 2011/0145940 A1 | 6/2011 | Voytas et al. |
| 2011/0151557 A1 | 6/2011 | Reh et al. |
| 2011/0165133 A1 | 7/2011 | Rabinovich et al. |
| 2011/0171185 A1 | 7/2011 | Klimanskaya et al. |
| 2011/0189137 A1 | 8/2011 | Rana et al. |
| 2011/0213335 A1 | 9/2011 | Burton et al. |
| 2011/0236978 A1 | 9/2011 | Stolzing et al. |
| 2011/0239315 A1 | 9/2011 | Bonas et al. |
| 2011/0244566 A1 | 10/2011 | Wu et al. |
| 2011/0263015 A1 | 10/2011 | D'Costa et al. |
| 2011/0301073 A1 | 12/2011 | Gregory et al. |
| 2012/0046346 A1 | 2/2012 | Rossi et al. |
| 2012/0064620 A1 | 3/2012 | Bonas et al. |
| 2012/0192301 A1 | 7/2012 | Jaenisch et al. |
| 2012/0195936 A1 | 8/2012 | Rudolph et al. |
| 2012/0202291 A1 | 8/2012 | Chen et al. |
| 2012/0208278 A1 | 8/2012 | Yanik et al. |
| 2012/0237975 A1 | 9/2012 | Schrum et al. |
| 2012/0301455 A1 | 11/2012 | Hunt |
| 2013/0040302 A1 | 2/2013 | Burke et al. |
| 2013/0071365 A1 | 3/2013 | Suzuki |
| 2013/0102034 A1 | 4/2013 | Schrum |
| 2013/0115272 A1 | 5/2013 | de Fougerolles et al. |
| 2013/0122581 A1 | 5/2013 | Voytas et al. |
| 2013/0123481 A1 | 5/2013 | de Fougerolles et al. |
| 2013/0156849 A1 | 6/2013 | de Fougerolles et al. |
| 2013/0165504 A1 | 6/2013 | Bancel et al. |
| 2013/0189327 A1 | 7/2013 | Ortega et al. |
| 2013/0189741 A1 | 7/2013 | Meis et al. |
| 2013/0203115 A1 | 8/2013 | Schrum et al. |
| 2013/0217119 A1 | 8/2013 | Bonas et al. |
| 2013/0244282 A1 | 9/2013 | Schrum et al. |
| 2013/0245103 A1 | 9/2013 | de Fougerolles et al. |
| 2013/0274129 A1 | 10/2013 | Katzen et al. |
| 2013/0302295 A1 | 11/2013 | Wang et al. |
| 2013/0345274 A1 | 12/2013 | Farber |
| 2014/0073053 A1 | 3/2014 | Yanik et al. |
| 2014/0073687 A1 | 3/2014 | Chien et al. |
| 2014/0127814 A1 | 5/2014 | Chandrasegaran et al. |
| 2014/0194482 A1 | 7/2014 | Farber et al. |
| 2014/0242154 A1 | 8/2014 | Ramunas et al. |
| 2014/0242155 A1 | 8/2014 | Ramunas et al. |
| 2014/0242595 A1 | 8/2014 | Yu et al. |
| 2014/0315988 A1 | 10/2014 | Dahl et al. |
| 2014/0349401 A1 | 11/2014 | Wang |
| 2014/0356906 A1 | 12/2014 | Angel et al. |
| 2015/0275193 A1 | 10/2015 | Angel et al. |
| 2016/0045600 A1 | 2/2016 | de Mollerat du Jeu et al. |
| 2016/0185681 A1 | 6/2016 | Fabry |
| 2019/0060482 A1 | 2/2019 | Mishra et al. |
| 2021/0032192 A1 | 2/2021 | Angel et al. |
| 2023/0373903 A1 | 11/2023 | Angel et al. |

FOREIGN PATENT DOCUMENTS

| | | |
|---|---|---|
| EP | 2272961 A1 | 1/2011 |
| EP | 2320952 B1 | 5/2011 |
| JP | 2003306448 | 10/2003 |
| JP | 2010246551 | 11/2010 |
| JP | 2011160661 | 8/2011 |
| WO | WO 96/10038 | 4/1996 |
| WO | WO 97/42819 | 11/1997 |
| WO | WO 98/00551 | 1/1998 |
| WO | WO 98/30679 | 7/1998 |
| WO | WO 00/12454 | 3/2000 |
| WO | WO 00/27795 | 5/2000 |
| WO | WO 00/74763 A2 | 12/2000 |
| WO | WO 00/77032 A2 | 12/2000 |
| WO | WO 02/26757 A2 | 4/2002 |
| WO | WO 02/094251 A1 | 11/2002 |
| WO | WO 03/086472 A1 | 4/2003 |
| WO | WO 2007/006808 A1 | 1/2007 |
| WO | WO 2007/024708 A2 | 3/2007 |
| WO | WO 2008/065381 A1 | 6/2008 |
| WO | WO 2009/006930 A1 | 1/2009 |
| WO | WO 2009/077134 A2 | 6/2009 |
| WO | WO 2009/127230 A1 | 10/2009 |
| WO | WO-2009132131 A1 | 10/2009 |
| WO | WO 2009/147400 A1 | 12/2009 |
| WO | WO 2010/012472 A1 | 2/2010 |
| WO | WO-2010042877 A1 | 4/2010 |
| WO | WO 2010/093655 A2 | 8/2010 |
| WO | WO 2010/123501 A1 | 10/2010 |

(56) References Cited

FOREIGN PATENT DOCUMENTS

| | | |
|---|---|---|
| WO | WO 2010/130447 A1 | 11/2010 |
| WO | WO 2010/148050 A2 | 12/2010 |
| WO | WO 2011/012316 A2 | 2/2011 |
| WO | WO 2011/134210 A1 | 3/2011 |
| WO | WO 2011/071931 A2 | 6/2011 |
| WO | WO 2011/071936 A2 | 6/2011 |
| WO | WO 2011/072246 A2 | 6/2011 |
| WO | WO 2011/110886 A1 | 9/2011 |
| WO | WO 2011/114237 A2 | 9/2011 |
| WO | WO 2011/130624 A2 | 10/2011 |
| WO | WO 2011/140397 A2 | 11/2011 |
| WO | WO 2011/141820 A1 | 11/2011 |
| WO | WO 2011/146121 A1 | 11/2011 |
| WO | WO 2011/154393 A1 | 12/2011 |
| WO | WO 2011/159369 A1 | 12/2011 |
| WO | WO 2012/019122 A2 | 2/2012 |
| WO | WO 2012/019168 A2 | 2/2012 |
| WO | WO 2012/036299 A1 | 3/2012 |
| WO | WO 2012/048213 A1 | 4/2012 |
| WO | WO 2012/060473 A1 | 5/2012 |
| WO | WO 2012/122318 A2 | 9/2012 |
| WO | WO 2012/131090 A1 | 10/2012 |
| WO | WO 2012/138453 A1 | 10/2012 |
| WO | WO 2012/138939 A1 | 10/2012 |
| WO | WO 2012/174224 A2 | 12/2012 |
| WO | WO 2012/176015 A1 | 12/2012 |
| WO | WO 2013/003475 A1 | 1/2013 |
| WO | WO 2013/020064 A1 | 2/2013 |
| WO | WO 2013/053819 A1 | 4/2013 |
| WO | WO 2013/078199 A2 | 5/2013 |
| WO | WO 2013/086008 A1 | 6/2013 |
| WO | WO 2013/102203 A1 | 7/2013 |
| WO | WO 2013/151671 A1 | 10/2013 |
| WO | WO 2013/163296 A1 | 10/2013 |
| WO | WO 2013/173248 A2 | 11/2013 |
| WO | WO 2014/015314 A1 | 1/2014 |
| WO | WO 2014/071219 A1 | 5/2014 |
| WO | WO 2014/134412 A1 | 9/2014 |
| WO | WO 2014/190361 A2 | 11/2014 |
| WO | WO 2015/038075 A1 | 3/2015 |
| WO | WO 2015/117021 A1 | 8/2015 |
| WO | WO-2016011203 A1 | 1/2016 |
| WO | WO 2016/131052 A1 | 8/2016 |
| WO | WO 2017/152015 A1 | 9/2017 |
| WO | WO 2018/035377 A1 | 2/2018 |
| WO | WO 2018/064584 A1 | 4/2018 |
| WO | WO 2019/045897 A1 | 3/2019 |
| WO | WO-2021003462 A1 | 1/2021 |
| WO | WO-2024197157 A1 | 9/2024 |

OTHER PUBLICATIONS

Ambegia, et al., "Stabilized plasmid-lipid particles containing PEG-diacylglycerols exhibit extended circulation lifetimes and tumor selective gene expression," Biochimica et Biophysica Acta (BBA)—Biomembranes, 169, 2005, pp. 155-163.

Anderson, et al., "Incorporation of pseudouridine into mRNA enhances translation by diminishing PKR activation," Nucl. Acids Res. 38(17): 5884-5892 (2010).

Anderson, et al., "Nucleofection induces transient eiF2a phosphorylation by GCN2 and PERK," Gene Ther., pp. 1-7 (2012).

Anderson, et al., "Nucleoside modifications in RNA limit activation of 2'-5'-oligoadenylate synthetase and increase resistance to cleavage by RNase L," Nucl. Acids Res. 39(21):9329-9338 (2011).

Angel, et al., "Innate Immune Suppression Enables Frequent Transfection with RNA Encoding Reprogramming Proteins," PLoS ONE, vol. 5(7), e11756, pp. 1-7 (2010).

Angel, "Extended Transient Transfection by Repeated Delivery of an In Vitro-Transcribed RNA," Master of Science in Electrical Engineering and Computer Science, 56 pages (Massachusetts Institute of Technology, Cambridge, Massachusetts) (2009).

Angel, "Reprogramming Human Somatic Cells to Pluripotency Using RNA", pp. 1-89 (Ph.D. diss., Massachusetts Institute of Technology) (2012).

Angel, "Reprogramming human somatic cells to pluripotency using RNA," Doctor of Philosophy in Electrical Engineering and Computer Science, 55 pages (Massachusetts Institute of Technology, Cambridge, Massachusetts) (2011).

Arnold, et al., "Reprogramming of Human Huntington Fibroblasts Using mRNA," ISRN Cell Biology 2012: Article ID 124878, pp. 1-12 (2012).

Ball, et al., "Achieving long-term stability of lipid nanparticles: examining the effect of pH, temperature, and lyophilization," International Journal of Nanomedicine, 12, 2017, pp. 305-315.

Ball, et al., "Lipid Nanoparticle Formulations for Enhanced Co-delivery of siRNA and mRNA," Nano Lett. 18, 2018, pp. 3814-3822.

Barker, et al., "A method for the deionization of bovine serum albumin," Tissue Culture Association, pp. 111-112 (1975).

Benner, N. L. et al., "Functional DNA Delivery Enabled by Lipid-Modified Charge-Altering Releasable Transporters (CARTs)", Biomacromolecules, 2018, vol. 19, pp. 2812-2824.

Berg, "Proposed structure for the zinc-binding domains from transcription factor IIIA and related proteins," Proc. Natl. Acad. Sci. USA, vol. 85, pp. 99-102 (1988).

Boch, et al., "Breaking the Code of DNA Binding Specificity of TAL-Type III Effectors," Science, vol. 3126, pp. 1509-1512 (2009).

Bogdanove, et al., "TAL effectors: customizable proteins for DNA targeting", Science, vol. 333, pp. 1843-1846 (2011).

Bolli, et al., "Cardiac stem cells in patients with ischaemic cardiomyopathy (SCIPIO): initial results of a randomized phase 1 trial," Lancet 378:1847-1857 (2011).

Braam, et al., "Recombinant vitronectin is a functionally defined substrate that supports human embryonic stem cell self-renewal via αv β5 integrin," Stem Cells 26:2257-2265 (2008).

Carroll, "Progress and prospects: Zinc-finger nucleases as gene therapy agents," Gene Therapy, vol. 15, pp. 1463-1468 (2008).

Chan, et al., "Optimizing Cationic and Neutral Lipids for Efficient Gene Delivery at High Serum Content," J Gene Medicine, 16, Mar. 2014, pp. 84-96.

Chen, et al., "Chemically defined conditions for human iPSC derivation and culture," Nat. Methods 8:424-429 (2011).

Chen, et al., "Metastasis is regulated via microRNA-200/ZEB1 axis control of tumour cell PD-L1 expression and intratumoral immunosuppression," Nature Communications, Oct. 28, 2014, 5: 5241, pp. 1-12.

Chen, et al., "Rational optimization of reprogramming culture conditions for the generation of induced pluripotent stem cells with ultra-high efficiency and fast kinetics," Cell Research 21:884-894 (2011).

Chen, et al., "Role of MEF feeder cells in direct reprograming of mousetail-tip fibroblasts." Cell Biology International., vol. 33, No. 12., pp. 1268-1273 (2009).

Christian, et al., "Targeting DNA Double-Strand Breaks with TAL Effector Nucleases," Genetics, vol. 186, pp. 757-761 (2010).

Cox, et al., "Therapeutic Genome Editing: Prospects and Challenges." Nat Med., vol. 21, No. 2 pp. 121-131 (2015).

Cui, et al., "Targeted integration in rat and mouse embryos with zinc-finger nucleases," Nat. Biotech., vol. 29, No. 1, pp. 64-67 (2011).

Dang, et al., "Mutation analysis and characterization of COL7A1 mutations in dystrophic epidermolysis bullosa." Experimental Dermatology, 17, 553-568 (2008).

Davis, "Stabilization of RNA stacking by pseudouridine," Nucleic Acids Research, vol. 23, No. 24, pp. 5020-5026 (1995).

Deng, et al."Structural Basis for Sequence-Specific Recognition of DNA by TAL Effectors" Science. 335(6069) 720-723 (2012).

Droge, et al., "A comparative study of some physico-chemical properties of human serum albumin samples from different sources. Some physico-chemical properties of isoionic human serum albumin solutions," Biochem. Pharmacal. 31, 3775-3779 (1982).

Efe, et al., "Conversion of mouse fibroblasts into cardiomyocytes using a direct reprogramming strategy," Nat. Cell Biol. 13:215-222 (2011).

Fixe, "Tebu-Bio.com; Cas9 mRNA optimized for genome editing." https://www.tebu-bio.com/blog/ 2015/09/07/cas9-nnrna-optimized-for-genonne-editing/) (2015).

(56) References Cited

OTHER PUBLICATIONS

Fritsch, et al., "Dominant-negative Effects of COL7A1 Mutations Can be Rescued by Controlled Overexpression of Normal Collagen VII," The Journal of Biological Chemistry, vol. 284, No. 44, pp. 30248-30256 (2009).
Garcia-Gonzalo, et al., "Albumin-associated lipids regulate human embryonic stem cell self-renewal," PLoS One 3: e1384, 1-10 (2008).
Gardner, et al., "Synthesis and Transfection Efficiencies of New Lipophilic Polyamines," J. Med. Chem., 50, 2007, pp. 308-318.
Geall, et al., "Nonviral delivery of self-amplifying RNA vaccines," National Academy of Sciences, 109, Sep. 2012, pp. 14604-14609.
Geurts, et al., "Knockout Rats via Embryo Microinjection of Zinc-Finger Nucleases," Science, vol. 325, p. 433 (2009).
Ghonaim, et al., "Varying the Chain Length in $N^4$, $N^9$-Diacyl Spermines: Non-Viral Lipopolyamine Vectors for Efficient Plasmid DNA formulation," Mol. Pharmaceutics, 5, 2008, pp. 1111-1121.
Goldberg, et al., "The enzymatic synthesis of pseudouridine triphosphate," Biochim. Biophys. Acta, vol. 54, pp. 202-204 (1961).
Goldberg, et al., "The incorporation of 5-ribosyluracil triphosphate into RNA in nuclear extracts of mammalian cells," Biochem. Biophys. Res. Commun. 6, pp. 394-398 (1961).
Goldberg, "Ribonucleic acid synthesis in nuclear extracts of mammalian cells grown in suspension culture; effect of ionic strength and surface-active agents," Biochim. Biophys. Acta, vol. 51, pp. 201-204 (1961).
Goto, et al., "Fibroblasts Show More Potential as Target Cells than Keratinocytes in Col7A1 Gene Therapy of Dystrophic Epidermolysis Bullosa", Journal of Investigative Dermatology 126, 766-772 (2006).
Goto, et al., "Targeted Skipping of a Single Exon Harboring a Premature Termination Codon Mutation: Implications and Potential for Gene Correction Therapy for Selective Dystrophic Epidermolysis Bullosa Patients," Journal of Investigative Dermatology, vol. 126, pp. 2614-2620 (2006).
"Guidance Notes for the Safe Storage and Handling of Cryogenic Materials", Dec. 2002, pp. 1-32, especially p. 2, [online] Retrieved from the Internet: https://www.st-andrews.ac.uk/staff/policy/healthandsafety/publications/cryogenics-safestorageandhandling/.
Gurung, et al., "β-Catenin is a Mediator of the Response of Fibroblasts to Irradiation," The American Journal of Pathology, vol. 174, No. 1, pp. 248-255 (2009).
Hamanaka, et al., "Generation of Germline-Component Rat Induced Pluripotent Stem Cells," PlosOne, vol. 6, Issue 7, pp. 1-9 (2011).
Heyes, et al., "Cationic lipid saturation influences intracellular delivery of encapsulated nucleic acids," Journal of Controlled Release, 107, 2005, pp. 276-287.
Hoban, et al. "Correction of the sickle cell disease mutation in human hematopoietic stem/progenitor cells" Blood 125(17):2597-2604 (2015).
Hockemeyer, et al., "Efficient targeting of expressed and silent genes in human ESCs and iPSCs using zinc-finger nucleases," Nature Biotechnology, vol. 27, No. 9, pp. 851-857 (2009).
Hockemeyer, et al., "Genetic engineering of human ES and iPS cells using TALE nucleases," Author Manuscript, available in PMC Feb. 1, 2012. Published in final edited form as: Nat Biotechnol. 29(8):731-734 (2012).
Jayaraman, et al., "Maximizing the Potency of siRNA Lipid Nanoparticles for Hepatic Gene Silencing In Vivo," Angewandte Chemie International Edition, 51, 2012, pp. 8529-8533.
Juillerat, et al., "Optimized tuning of TALEN specificity using non-conventional RVDs", Sci. Rep., vol. 5:8150, pp. 1-7 (2015).
Kahan, et al., "The Role of Deoxyribonucleic Acid in Ribonucleic Acid Synthesis," The Journal of Biological Chemistry, vol. 237, No. 12, pp. 3778-3785 (1962).
Kariko, et al., "Generating the optimal mRNA for therapy: HPLC purification eliminates immune activation and improves translation of nucleoside-modified, protein-encoding mRNA," Nucl. Acids Res. 39:e142 (2011).
Kariko, et al., "In vivo protein expression from mRNA delivered into adult rat brain," J. Neurosci. Methods 105:77-86 (2001).
Kariko, et al., "Incorporation of pseudouridine into mRNA yields superior nonimmunogenic vector with increased translational capacity and biological stability," Mol. Ther. 16:1833-1840 (2008).
Kariko, et al., "Increased Erythropoiesis in Mice Injected with Sub-Microgram Quantities of Pseudouridine-containing mRNA Encoding Erythropoietin," Mol. Ther. 20:948-953 (2012).
Kariko, et al., "mRNA is an endogenous ligand for Toll-like receptor 3," J. Biol. Chem. 279, pp. 12542-12550 (2004).
Kariko, et al., "Naturally occurring nucleoside modifications suppress the immunostimulatory activity of RNA: implication for therapeutic RNA development," Drug Discovery & Development, vol. 10, No. 5, pp. 523-532 (2007).
Kariko, et al., "Suppression of RNA recognition by Toll-like receptors: the impact of nucleoside modification and the evolutionary origin of RNA," Immunity 23:165-175 (2005).
Kauffman, et al., "Optimization of Lipid Nanoparticle Formulations for mRNA Delivery in vivo with Fractional Factorial and Definitive Screening Designs," Nano Letters, 15, 2015, pp. 7300-7306.
Kawamata, et al., "Generation of genetically modified rats from embryonic stem cells," PNAS, vol. 107, No. 32, pp. 14223-14228 (2010).
Kern, et al., "Mechanisms of Fibroblast Cell Therapy for Dystrophic Epidermolysis Bullosa: High Stability of Collagen VII Favors Long-term Skin Integrity," Molecular Therapy, vol. 17, No. 9, 1605-1615 (2009).
Kim, et al., "Direct reprogramming of human neural stem cells by OCT4," Nature 461:649-653 (2009).
Kim, et al., "Generation of Human Induced Pluripotent Stem Cells by Direct Delivery of Reprogramming Proteins," Cell Stem Cell 4, pp. 472-476 (2009).
Kim, et al., "Hybrid restriction enzymes: Zinc finger fusions to Fok I cleavage domain," Proc. Natl. Acad. Sci. USA, vol. 93, pp. 1156-1160 (1996).
Kim, et al., "Oct4-induced pluripotency in adult neural stem cells," Cell 136:411-419 (2009).
Kim, et al., "Pluripotent stem cells induced from adult neural stem cells by reprogramming with two factors," Nature 454:646-650 (2008).
Kita, K. et al., "Overproduction and characterization of the StsI restriction endonuclease", Gene, vol. 169, pp. 69-73 (1996).
Krug, et al., "A GMP-compliant protocol to expand and transfect cancer patient T cells with mRNA encoding a tumor-specific chimeric antigen receptor." Cancer Immunol Immunother., pp. 1-10 (2014).
Kulkarni, et al., "Design of lipid nanoparticles for in vitro and in vivo delivery of plasmid DNA," Nanomedicine: Nanotechnology, Biology and Medicine 13, 2017, pp. 1377-1387.
Kulkarni, et al., "On the Formation and Morphology of Lipid Nanoparticles Containing Ionizable Cationic Lipids and siRNA," ACS Nano, 12, 2018, pp. 4787-4795.
Labas, et al., "Nature as a source of inspiration for cationic lipid synthesis," Genetica, 13, 2010, pp. 153-168.
Lee, et al., "Activation of Innate Immunity is Required for Efficient Nuclear Reprogramming," Cell 151,547-558 (2012).
Li, et al., "Effects of Chemically Modified Messenger RNA on Protein Expression," Bioconjugate Chem., Feb. 24, 2016, 27: pp. 849-853.
Li, et al., "Identification and characterization of mitochondrial targeting sequence of human apurinic/apyrimidinic endonuclease 1." Journal of Biological Chemistry, 285(20): 14871-14881 (2010).
Li, et al., "A biomimetic lipid library for gene delivery through thiol-yne click chemistry," Biomaterials 33, 2012, pp. 8160-8166.
Lin, et al., "A chemical platform for improved induction of human iPSCs," Nature Methods, vol. 6, No. 11, 805-808 (2009).
Product manual for Lipofectamine 2000 transfection reagent, Protocol Pub. No. MAN0007824 Rev.1.0, Thermo Fisher Scientific, Jun. 12, 2013 (https://assets.thermofisher.com/TFS-Assets/LSG/manuals/Lipofectamine_2000_Reag_protocol.pdf/ Accessed Oct. 22, 2019).
Product manual for Lipofectamine 3000 transfection reagent, Protocol Pub. No. MAN0009872 Rev.C.0, Invitrogen by Life Technologies, Thermo Fisher Scientific, Feb. 10, 2016 (https://www.

(56) References Cited

OTHER PUBLICATIONS thermofisher.com/content/dam/LifeTech/Documents/PDFs/lipofectamine3000_protocol.pdf/ Accessed Oct. 22, 2019).
Liu, et al., "A Small-Molecule Agonist of the Wnt Signaling Pathway," Angew. Chem. Int. Ed. 44, pp. 1987-1990 (2005).
Love, et al., "Lipid-like materials for low-dose, in vivo gene silencing," PNAS, vol. 107, No. 5, 2010, pp. 1864-1869.
Lu, et al. "Defined culture conditions of human embryonic stem cells" PNAS, 103, 5688-5693 (2006).
Ludwig, et al., "Derivation of human embryonic stem cells in defined conditions," Nat. Biotechnol. 24:185-187 (2006).
Ludwig, et al., "Feeder-independent culture of human embryonic stem cells," Nat. Methods 3:637-646 (2006).
Mahfouz, et al., "De novo-engineered transcription activator-like effector (TALE) hybrid nuclease with novel DNA binding specificity creates double-strand breaks," PNAS vol. 108, No. 6, pp. 2623-2628 (2011).
Mahon, et al., "A combinatorial approach to determine functional group effects on lipidoid-mediated siRNA delivery," Bioconjugate Chem, 21(8), Aug. 18, 2010, pp. 1448-1454.
Maier, et al., "Biodegradable Lipids Enabling Rapidly Eliminated Lipid Nanoparticles for Systemic Delivery of RNAi Therapeutics," The American Society of Gene & Cell Therapy, vol. 21, No. 8, Aug. 2013, pp. 1570-1578.
Maiti, et al., "Transfection efficiencies of α-tocopherylated cationic gemini lipids with hydroxyethyl bearing headgroups under high serum conditions," Org. Biomol. Che., 16, 2018, pp. 1983-1993.
Martinov, et al., "Fractioned radiotherapy combined with PD-1 pathway blockade promotes CD8 T cell-mediated tumor clearance for the treatment of advanced malignancies," Annals of Translational Medicine, Feb. 2016, 4(4): 82, pp. 1-4.
Mayr, et al., "Gene Therapy for the COL7A1 Gene" Open access peer-reviewed chapter. https://www.intechopen.com/books/gene-therapy-tools-and-potential-applications/gene-therapy-for-the-col7a1-gene Published Feb. 27, 2013.
Menger, et al. "TALEN-Mediated Inactivation of PD-1 in Tumor-Reactive Lymphocytes Promotes Intratumoral T-cell Persistence and Rejection of Established Tumors". Cancer Res. 76(8): 2087-2093 (2016).
Miller, et al., "A Tale nuclease architecture for efficient genome editing," Nature Biotechnology, vol. 29, No. 2, pp. 143-148 (2011).
Miller, et al., "An improved zinc-finger nuclease architecture for highly specific genome editing," Nat. Biotechnol.; vol. 25, No. 7, pp. 778-785 (2007).
Misra, et al., "Gene Transfection in High Serum Levels: Case Studies with New Cholesterol Based Cationic Gemini Lipids," PLOS ONE, vol. 8, No. 7, Jul. 2013, e68305.
Moscou, et al., "A Simple Cipher Governs DNA Recognition by TAL Effectors," Science, vol. 326, p. 1501 (2009).
Mui, et al., "Influence of Polyethylene Glycol Lipid Desorption Rates on Pharmacokinetics and Pharmacodynamics of siRNA Lipid Nanoparticles," Molecular Therapy, 2, 2013, e139.
Murauer, et al., "Functional Correction of Type VII Collagen Expression in Dystrophic Epidermolysis Bullosa," Journal of Investigative Dermatology, vol. 131, pp. 74-83 (2011).
Nabhan, et al., "Intrathecal delivery of frataxin mRNA encapsulated in lipid nanoparticles to dorsal root ganglia as a potential therapeutic for Friedreich's ataxia," Scientific Reports, 6, 2016.
Ng, et al., "A protocol describing the use of a recombinant protein-based, animal product-free medium (APEL) for human embryonic stem cell differentiation as spin embryoid bodies," Nat. Protoc. 3:768-776 (2008).
Niu, et al., "Engineering Variants of the I-SceI Homing Endonuclease with Strand-specific and Site-specific DNA-nicking Activity, Journal of Molecular Biology" vol. 382, pp. 188-202 (2008).
Niyomtham, et al., "Synthesis and in vitro transfection efficiency of spermine-based cationic lipids with different central core structures and lipophilic tails," Bioorganic & Medicianl Chemisty Letters, 25, 2015, pp. 496-503.

Okita, et al., "Generation of germline-competent induced pluripotent stem cells," Nature, vol. 448, pp. 313-317 (2007).
Osborn, et al., "Talen-based Gene Correction for Epidermolysis Bullosa," Molecular Therapy vol. 21, No. 6, pp. 1151-1159 (2013).
Ousterout, et al., Genetic Correction of Dystrophin by Engineered Nucleases, Mol. Ther., vol. 20, pp. S26-S27 (2012).
Pardi, et al., "Expression kinetics of nucleoside-modified mRNA delivered in lipid nanoparticles to mice by various routes," J Control Release, 217, Nov. 10, 2015, pp. 345-351.
Payton, et al., "Long Term Storage of Lyophilized Liposomal Formulations," Journal of Pharmaceutical Sciences, 103 (12), Dec. 2014, pp. 3869-3878.
Porteus, et al., "Gene targeting using zinc finger nucleases," Nat. Biotechnol., vol. 23, No. 8, pp. 967-973 (2005).
Potter, et al., "Transfection by Electroporation," Curr Protoc Mol Biol., Chapter: Unit-.3. doi:10.1002-0471142727.mb0903s62, pp. 1-12,(2003).
Remington, et al., "Injection of recombinant human type VII collagen corrects the disease phenotype in a murine model of dystrophic epidermolysis bullosa", Molecular Therapy. vol. 17, No. 1, pp. 26-33 (2009).
Rossi, et al., "Anti-inflammatory cyclopentenone prostaglandins are direct inhibitors of IKB kinase," Nature, vol. 403, pp. 103-108 (2000).
Sabnis, et al., "A Novel Amino Lipid Series for mRNA Delivery: Improved Endosomal Escape and Sustained Pharmacology and Safety in Non-human Primates," Molecular Therapy, vol. 26, No. 6, Jun. 2018, pp. 1509-1519.
Sander, et al., "Targeted gene disruption in somatic zebrafish cells using engineered TALENs," Author Manuscript, available in PMC on Feb. 5, 2012. Published in final edited form as: Nat Biotechnol. 29(8): 697-698 (2012).
Sanjana, et al., "A transcription activator-like effector toolbox for genome engineering," Nature Protocols, vol. 7, No. 1, pp. 171-192 (2012).
Schneider, "An Effective Method for Defatting Albumin Using Resin Columns," Biochim. Biophys. Acta, 221, 376-378 (1970).
Schwartz, et al., "Embryonic stem cell trials for macular degeneration: a preliminary report," Lancet 379:713-720 (2012).
Sebastiano, et al. "In Situ Genetic Correction of the Sickle Cell Anemia Mutation in Human Induced Pluripotent Stem Cells Using Engineered Zinc Finger Nucleases" Stem Cells 29:1717-1726 (2011).
Semple, et al., "Rational design of cationic lipids for siRNA delivery," Nature Biotechnology, 28, 2010, pp. 172-176.
Shaker, et al., "Factors affecting liposomes particle size prepared by ethanol injection method," Res Pharma Sci, 12, 2017, pp. 347-352.
Shimizu, et al., "Transformation by Wnt Family Proteins Correlates with Regulation of β-Catenin," Cell Growth & Differentiation, vol. 8, pp. 1349-1358 (1997).
Shobaki, et al., "Mixing lipids to manipulate the ionization status of lipid nanoparticles for specific tissue targeting," International Journal of Nanomedicine, 13, 2013, pp. 8395-8410.
Soldner, et al., "Generation of isogenic pluripotent stem cells differing exclusively at two early onset Parkinson point mutations," Author Manuscript, available in PMC on Jul. 22, 2012. Published in final edited form as: Cell. Jul. 22, 2011; 146(2): 318-331 (2011).
Stark, et al., "Long-term stability of sterically stabilized liposomes by freezing and freeze-drying: Effects of cryoprotectans on structure," European Journal of Pharmaceutical Sciences, 41, 2010, pp. 546-555.
Su, et al. "CRISPR-Cas9 mediated efficient PD-1 disruption on human primary T cells from cancer patients." Sci. Rep. 6, 20070; doi: 10.1038/srep20070; pp. 1-13; Corrigendum, p. 1 (2016).
Sugii, et al., "Human and mouse adipose-derived cells support feeder-independent induction of pluripotent stem cells." PNAS, vol. 107, No. 8, pp. 2558-2563 (2010).
Sun and Zhao, "Seamless correction of the sickle cell disease mutation of the HBB gene in human induced pluripotent stem cells using TALENs" Biotechnology and Bioengineering 111(5):1048-1053 (2014).
Takahashi and Yamanaka, "Induction of pluripotent stem cells from mouse embryonic and adult fibroblast cultures by defined factors," Cell 126:663-676 (2006).

(56) References Cited

OTHER PUBLICATIONS

Takahashi, et al., "Induction of pluripotent stem cells from adult human fibroblasts by defined factors," Cell 131:861-872 (2007).
Teo, Pei Yun, "Nucleic acid delivery using poly(ethylenimine)-based polymers for programmed death-ligand 1 (PD-L1) knockdown in ovarian cancer to enhance immunotherapy," Ph.D. Dissertation, Imperial College, London, Jun. 2015.
Tesson, et al., "Knockout rats generated by embryo microinjection of TALENs," Nature Biotechnology, vol. 29, No. 8, pp. 695-696 (2011).
Titeux, et al., "Gene Therapy for Recessive Dystrophic Epidermolysis Bullosa," Dermatologic Clinics, vol. 28, pp. 361-366 (2010).
Tolar, et al., "Patient-Specific Naturally Gene-Reverted Induced Pluripotent Stem Cells in Recessive Dystrophic Epidermolysis Bullosa," Journal of Investigative Dermatology, vol. 134, pp. 1246-1254 (2014).
Wally, et al., "Spliceosome-Mediated Trans-Splicing: The Therapeutic Cut and Paste," Journal of Investigative Dermatology, vol. 132, pp. 1959-1966 (2012).
Warren, et al., "Highly efficient reprogramming to pluripotency and directed differentiation of human cells with synthetic modified mRNA," Cell. Stem Cell 7:618-630 (2010).
Watanabe, et al., "A Rock inhibitor permits survival of dissociated human embryonic stem cells," Nature Biotechnology, vol. 25, No. 6, pp. 681-686 (2007).
Wei, et al., "An Electroporation Chip Based on Flexible Microneedle Array for In Vivo Nucleic Acid Delivery," MEMS, 2014, San Francisco, CA, USA, pp. 817-820 (2014).
Wernig, et al., "In vitro reprogramming of fibroblasts into a pluripotent ES-cell-like state," Nature, vol. 448, pp. 317-324 (2007).
Whitehead, et al., "The in Vitro—in vivo Translation of Lipid Nanoparticles for Hepatocellular siRNA Delivery," ACS Nano, 6, 2012, pp. 6922-6929.
Wilson, et al., "Real Time Measurement of PEG Shedding from Lipid Nanoparticles in Serum via NMR Spectroscopy," Molecular Pharmaceutics, 12, 2015, pp. 386-392.
Wong, et al., "Potential of Fibroblast Cell Therapy for Recessive Dystrophic Epidermolysis Bullosa", Journal of Investigative Dermatology (2008) 128, 2179-2189.
Wood, et al., "Targeted Genome Editing Across Species Using ZFNs and TALENs," Science, vol. 333, p. 307 (2011).
Woodley, et al., "Intradermal injection of lentiviral vectors corrects regenerated human dystrophic epidermolysis bullosa skin tissue in vivo". Mol Ther; 10(2):318-26 (2004).
Wu, et al., "TALEN-mediated genetic tailoring as a tool to analyze the function of acquired mutations in multiple myeloma cells," Blood Cancer Journal (2014), 4, e210, pp. 1-5.
"Xeno-Free System for hESC & hiPSC. Facilitating the Shift from Stem Cell Research to Clinical Applications." 12 pages, Biological Industries Catalog (Stem Cell Products) (2011).
Xie, et al., "Newly expressed proteins of mouse embryonic fibroblasts irradiated to be inactive," Biochem. Biophys. Res. Commun. 315, pp. 581-588 (2004).
Yakubov, et al., "Reprogramming of human fibroblasts to pluripotent stem cells using mRNA of four transcription factors," Biochem. Biophys. Res. Commun. 394:189-193 (2010).
Yanez, et al., "Successful reprogramming of cellular protein production through mRNA delivered by functionalized lipid nanoparticles," Proceedings of the National Academy of Sciences, 115, 2018, pp. E3350-E3360.
Yang, et al., "Overcoming the inhibitory effect of serum on lipofection by increasing the charge ratio of cationic liposome to DNA," Gene Therapy, 4, 1997, pp. 950-960.
Yang, et al., "Time-dependent maturation of cationic liposome-DNA complex for serum resistance," Gene Therapy, 5, 1998, pp. 380-387.
Yi, et al., "CRISPR-Cas9 therapeutics in cancer: promising strategies and present challenges," Biochimica et Biophysica Acta 1866, 2016, pp. 197-207.
You, et al., "Wnt signaling promotes oncogenic transformation by inhibiting c-Myc-induced apoptosis," The Journal of Cell Biology, vol. 157, No. 3, pp. 429-440 (2002).
Young, et al., "Background Mutations in Parental Cells Account for Most of the Genetic Heterogeneity of Induced Pluripotent Stem Cells," Cell Stem Cell 10, pp. 570-582 (2012).
Yu, et al., "Induced pluripotent stem cell lines derived from human somatic cells," Science 318:1917-1920 (2007).
Zhou, et al., "Generation of Induced Pluripotent Stem Cells Using Recombinant Proteins," Cell Stem Cell 4, pp. 1-4 (2009).
U.S. Appl. No. 16/931,901 Office Action dated Sep. 22, 2021.
U.S. Appl. No. 17/553,564 Office Action dated Jul. 14, 2023.
U.S. Appl. No. 18/362,789 Office Action dated May 31, 2024.
U.S. Appl. No. 18/362,789 Office Action dated Feb. 18, 2025.

CATIONIC LIPIDS AND TRANSFECTION METHODS

PRIORITY

The present application claims priority to U.S. patent application Ser. No. 16/746,279, filed on Jan. 17, 2020, U.S. Provisional Application No. 62/870,245, filed on Jul. 3, 2019, U.S. Provisional Application No. 62/880,435, filed on Jul. 30, 2019, and U.S. Provisional Application No. 63/023,654, filed on May 12, 2020, the contents of which are herein incorporated by reference in their entireties.

FIELD OF THE INVENTION

The present invention relates, in part, to various novel lipids, including methods, compositions, and products for delivering nucleic acids to cells.

DESCRIPTION OF THE TEXT FILE SUBMITTED ELECTRONICALLY

The instant application contains a Sequence Listing which has been submitted in ASCII format via EFS-Web and is hereby incorporated by reference in its entirety. Said ASCII copy, created on Aug. 18, 2023, is named 61057_712_202_SL_v2.txt and is 1,442,287 bytes in size.

BACKGROUND

Lipid-based materials, such as liposomes, are used as biological carriers for pharmaceutical and other biological applications, e.g., to introduce agents into cultured cell lines. Lipids are commonly used to deliver nucleic acids to cells in vitro under low-serum or serum-free conditions, for instance in transfection. However, serum components inhibit the activity of many lipids, limiting their use in the presence of serum, both in vitro and in vivo.

Improved lipid delivery systems, e.g., to achieve higher levels of transfection both in vitro and in vivo, are desirable. In particular, lipid delivery systems that are active in the presence of serum are needed. Improved levels of transfection will allow the treatment of disease states for which higher levels of expression than are currently achievable with lipid delivery systems are needed for therapeutic effect. Alternatively, higher transfection levels will allow for use of smaller amounts of material to achieve comparable expression levels, thereby decreasing potential toxicities and decreasing cost.

There is a need for novel lipids, lipid-like materials, and lipid-based delivery systems in the art.

SUMMARY OF THE INVENTION

Accordingly, the present invention relates to new lipids that find use, inter alia, in improved delivery of biological payloads, e.g. nucleic acids, to cells.

In aspects, the present invention relates to a compound of Formula (I)

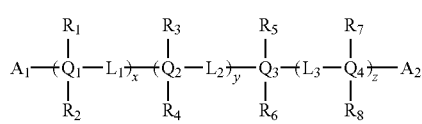

(I)

wherein: $Q_1$, $Q_2$, $Q_3$, and $Q_4$ are independently an atom or group capable of adopting a positive charge;

$A_1$ and $A_2$ are independently null, H, or optionally substituted $C_1$-$C_6$ alkyl;

$L_1$, $L_2$, and $L_3$ are independently null, a bond, ($C_1$-$C_{20}$)alkanediyl, (halo)($C_1$-$C_{20}$)alkanediyl, (hydroxy)($C_1$-$C_{20}$)alkanediyl, (alkoxy)($C_1$-$C_{20}$)alkanediyl, arylene, heteroarylene, cycloalkanediyl, heterocycle-diyl, or any combination of the aforementioned optionally linked by one or more of an ether, an ester, an anhydride, an amide, a carbamate, a secondary amine, a tertiary amine, a quaternary ammonium, a thioether, a urea, a carbonyl, or an imine;

$R_1$, $R_2$, $R_3$, $R_4$, $R_5$, $R_6$, $R_7$, and $R_8$ are independently null, H, ($C_1$-$C_{60}$)alkyl, (halo)($C_1$-$C_{60}$)alkyl, (hydroxy)($C_1$-$C_{60}$)alkyl, (alkoxy)($C_1$-$C_{60}$)alkyl, ($C_2$-$C_{60}$)alkenyl, (halo)($C_2$-$C_{60}$)alkenyl, (hydroxy)($C_2$-$C_{60}$)alkenyl, (alkoxy)($C_2$-$C_{60}$)alkenyl, ($C_2$-$C_{60}$)alkynyl, (halo)($C_2$-$C_{60}$)alkynyl, (hydroxy)($C_2$-$C_{60}$)alkynyl, (alkoxy)($C_2$-$C_{60}$)alkynyl, wherein at least one of $R_1$, $R_2$, $R_3$, $R_4$, $R_5$, $R_6$, $R_7$, and $R_8$ comprises at least two unsaturated bonds; and x, y, and z are independently 0, 1, 2, 3, 4, 5, 6, 7, 8, 9, 10, 11, 12, 13, 14, or 15.

In aspects, the present invention relates to a compound of Formula (II):

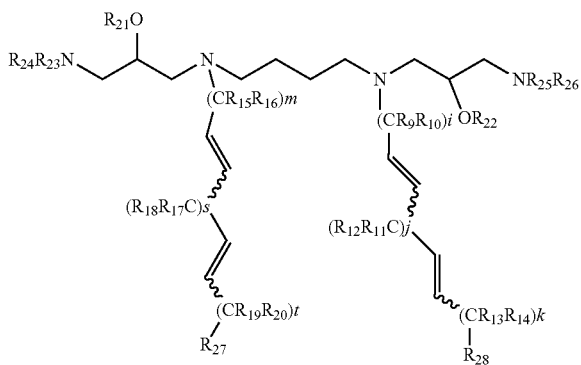

(II)

wherein:
R9, R10, R11, R12, R13, R14, R15, R16, R17, R18, R19, R20, R21, R22, R23, R24, R25, R26, R27, and R28 are independently H, halo, OH, ($C_1$-$C_6$)alkyl, (halo)($C_1$-$C_6$)alkyl, (hydroxy)($C_1$-$C_6$)alkyl, (alkoxy)($C_1$-$C_6$)alkyl, aryl, heteroaryl, cycloalkyl, or heterocyclo; and j, k, m, s, and t are independently 0, 1, 2, 3, 4, 5, 6, 7, 8, 9, 10, 11, 12, 13, 14, or 15.

In aspects, the present invention relates to a compound of Formula (III):

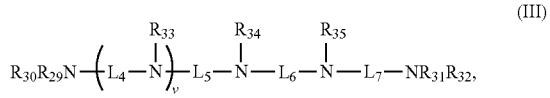

(III)

wherein $L_4$, $L_5$, $L_6$, and $L_7$ are independently a bond, ($C_1$-$C_{20}$)alkanediyl, (halo)($C_1$-$C_{20}$)alkanediyl, (hydroxy)($C_1$-$C_{20}$)alkanediyl, (alkoxy)($C_1$-$C_{20}$)alkanediyl, arylene, heteroarylene, cycloalkanediyl, heterocycle-diyl, —($CH_2$)$_{v1}$—C(O)—, —(($CH_2$)$_{v1}$—O)$_{v2}$—, or —(($CH_2$)$_{v1}$—C(O)—O)$_{v2}$—;

$R_{29}$, $R_{30}$, $R_{31}$, $R_{32}$, $R_{33}$, $R_{34}$, and $R_{35}$ are independently H, $(C_1-C_{60})$alkyl, (halo)$(C_1-C_{60})$alkyl, (hydroxy)$(C_1-C_{60})$alkyl, (alkoxy)$(C_1-C_{60})$alkyl, $(C_2-C_{60})$alkenyl, (halo)$(C_2-C_{60})$alkenyl, (hydroxy)$(C_2-C_{60})$alkenyl, (alkoxy)$(C_2-C_{60})$alkenyl, $(C_2-C_{60})$alkynyl, (halo)$(C_2-C_{60})$alkynyl, (hydroxy)$(C_2-C_{60})$alkynyl, (alkoxy)$(C_2-C_{60})$alkynyl, wherein at least one of $R_{29}$, $R_{30}$, $R_{31}$, $R_{32}$, $R_{33}$, $R_{34}$, and $R_{35}$ comprises at least two unsaturated bonds;

v, $v_1$ and $v_2$ are independently 0, 1, 2, 3, 4, 5, 6, 7, 8, 9, 10, 11, 12, 13, 14, or 15.

In embodiments, the present invention relates to a compound of Formula (IV):

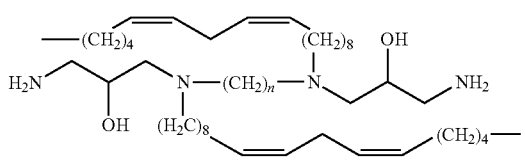
(IV)

wherein n is 1, 2, 3, 4, 5, 6, 7, 8, 9, 10, 11, 12, 13, 14, or 15.

In embodiments, the present invention relates to a compound of Formula (V):

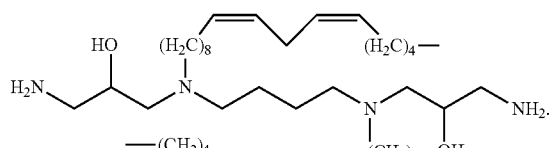
(V)

In embodiments, the present invention relates to a compound of Formula (VI):

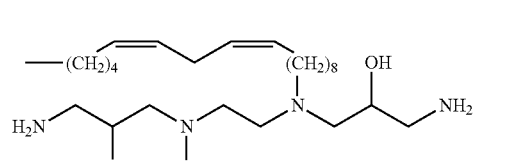
(VI)

In embodiments, the present invention relates to a compound of Formula (VII):

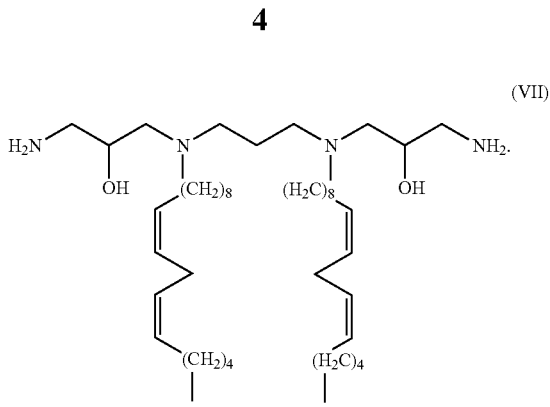
(VII)

In embodiments, the present invention relates to a compound of Formula (VIII):

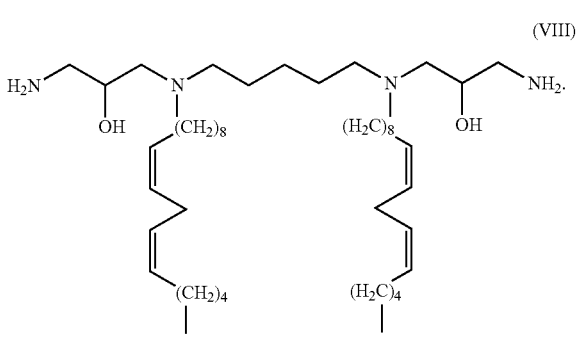
(VIII)

In embodiments, the present invention relates to a compound of Formula (IX):

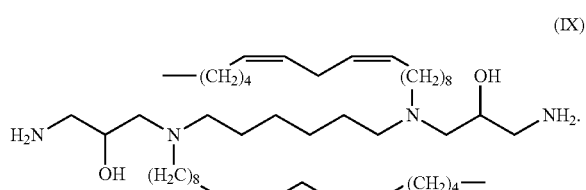
(IX)

In embodiments, the present invention relates to a compound of Formula (X):

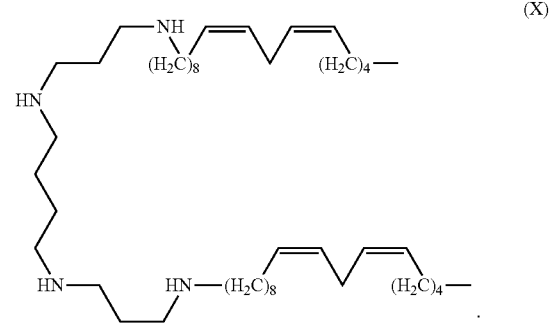
(X)

In embodiments, the present invention relates to a compound of Formula (XI):

(XI)

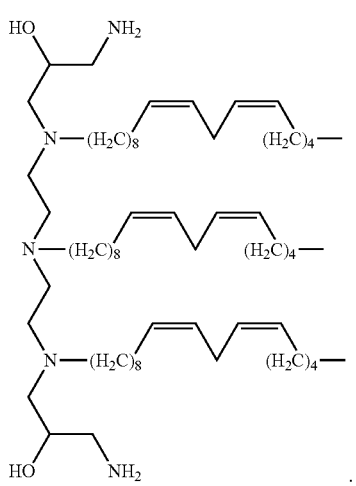

In embodiments, the present invention relates to a compound of Formula (XII):

(XII)

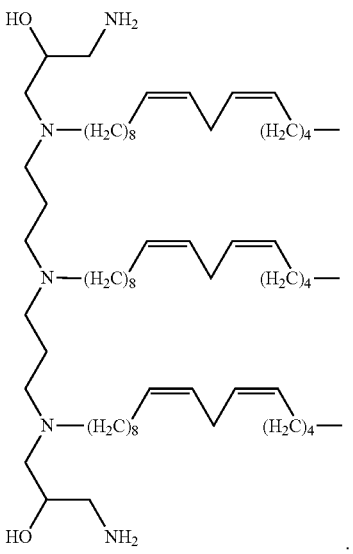

In embodiments, the present invention relates to a compound of Formula (XIII):

(XIII)

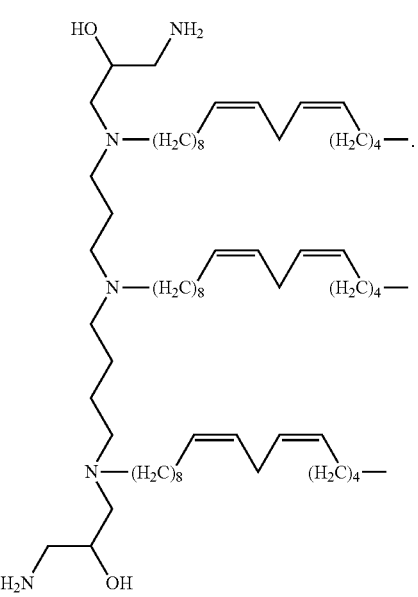

In embodiments, the present invention relates to a compound of Formula (XIV):

(XIV)

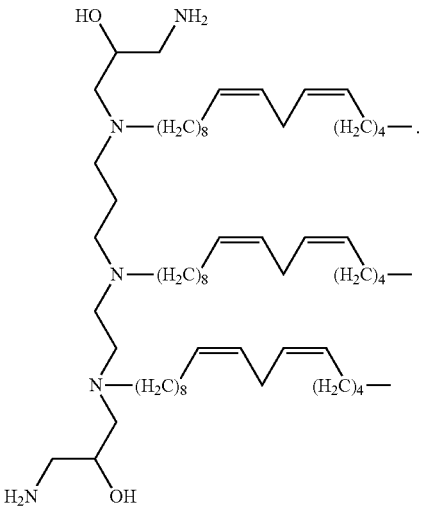

In embodiments, the present invention relates to a compound of Formula (XV):

(XV)

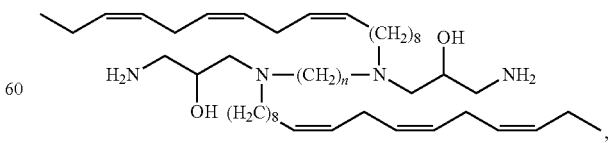

wherein n is 1, 2, 3, 4, 5, 6, 7, 8, 9, 10, 11, 12, 13, 14, or 15.

In embodiments, the present invention relates to a compound of Formula (XVI):

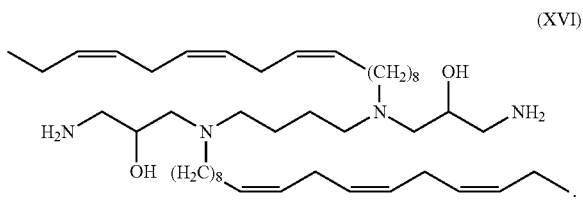

(XVI)

In embodiments, the present compounds (e.g. of Formulae I-XVI) are components of a pharmaceutical composition and/or a lipid aggregate and/or a lipid carrier and/or a lipid nucleic-acid complex and/or a liposome and/or a lipid nanoparticle.

In embodiments, the present compounds (e.g. of Formulae I-XVI) are components of a pharmaceutical composition and/or a lipid aggregate and/or a lipid carrier and/or a lipid nucleic-acid complex and/or a liposome and/or a lipid nanoparticle which does not require an additional or helper lipid. In embodiments, the present compounds (e.g. of Formulae I-XVI) are components of a pharmaceutical composition and/or a lipid aggregate and/or a lipid carrier and/or a lipid nucleic-acid complex and/or a liposome and/or a lipid nanoparticle that further comprises a neutral lipid (e.g. dioleoylphosphatidylethanolamine (DOPE), 1,2-Dioleoyl-sn-glycero-3-phosphocholine (DOPC), or cholesterol) and/or a further cationic lipid (e.g. N-[1-(2,3-dioleoyloxy)propyl]-N,N,N-trimethylammonium chloride (DOTMA), 1,2-bis(oleoyloxy)-3-3-(trimethylammonium) propane (DOTAP), or 1,2-dioleoyl-3-dimethylammonium-propane (DODAP)).

In embodiments, the present compounds (e.g. of Formulae I-XVI) are components of a pharmaceutical composition and/or a lipid aggregate and/or a lipid carrier and/or a lipid nucleic-acid complex and/or a liposome and/or a lipid nanoparticle with a defined particle size. In some embodiments, the particles comprising the present compounds (e.g. of Formulae I-XVI) are characterized to determine mean particle size and polydispersity. In some embodiments, particles comprising the present compounds have a mean hydrodynamic radius of <50 nm, 50-100 nm, 100-150 nm, 150-200 nm, 200-250 nm, 250-500 nm, or >500 nm. In some embodiments, the mean particle size is dependent on conditions of the process of particle formation (e.g., without limitation, temperature, incubation time, solution pH, or solution ionic strength). In some embodiments, the present compounds (e.g. of Formulae I-XVI) are components of a pharmaceutical composition and/or a lipid aggregate and/or a lipid carrier and/or a lipid nucleic-acid complex and/or a liposome and/or a lipid nanoparticle with a mean particle size that is dependent on the ionic strength of the solution, or on the pH of the solution.

In embodiments, the present compounds (e.g. of Formulae I-XVI) are components of a pharmaceutical composition and/or a lipid aggregate and/or a lipid carrier and/or a lipid nucleic-acid complex and/or a liposome and/or a lipid nanoparticle which comprises a nucleic acid, such as DNA (e.g., without limitation, a plasmid, cosmid, phage, recombinant virus or other vector) or RNA (e.g., without limitation, an siRNA, micro-RNA (miRNA), long non-coding RNA (lncRNA), an in vitro-transcribed RNA, a synthetic RNA, and/or an mRNA, in each case that comprises one or more non-canonical nucleotides that confer stability, avoid degradation by one or more nucleases, and/or avoid substantial cellular toxicity, or does not comprise a non-canonical nucleotide). In embodiments, the RNA encodes a protein of interest, e.g., without limitation, one or more reprogramming factors or gene-editing proteins. In embodiments, the RNA encodes an antigen which provokes an immune response.

In embodiments, the invention relates to the delivery of synthetic RNA molecules that are capable of inducing immunotoleration to an encoded protein (e.g., without limitation, a synthetic RNA molecule comprising a microRNA binding site (such as, for instance a miR142 micro-RNA binding site), such microRNA binding site optionally being present in the 3'-UTR of the synthetic RNA molecule (optionally in one or more copies). In embodiments, the invention relates to the delivery of synthetic RNA molecules that are capable of inducing immunotoleration to an encoded protein by co-delivery of a factor that induces tolerance (e.g., without limitation, IL2, IL10, and/or tgf-β). In certain embodiments the co-delivered factors are expressed by synthetic RNA molecules. In embodiments, the synthetic RNA molecules encode one or more gene-editing proteins described herein. In one embodiment, the synthetic RNA molecule induces immunotoleration of the one or more gene-editing proteins. In another embodiment, the synthetic RNA molecule encodes a protein that is not normally present in the subject. In some embodiments, the subject has dystrophic epidermolysis bullosa. In other embodiments, the synthetic RNA molecule encodes one or more gene-editing proteins that create a double-strand break into which a genetic payload is inserted. In some embodiments the genetic payload comprises an expression cassette. In other embodiments, the expression cassette induces the cell to express a therapeutic protein. In still other embodiments, the therapeutic protein is immunotolerated. In further embodiments, the one or more gene-editing proteins induce the cell to express a functional or semi-functional version of a protein. In one embodiment, the protein is collagen 7. Certain embodiments are directed to a composition for treating a disease, disorder, or condition, wherein the composition comprises a synthetic RNA molecule of the present invention. In one embodiment, the disease, disorder, or condition is dystrophic epidermolysis bullosa.

In embodiments, the pharmaceutical composition and/or lipid aggregate and/or lipid carrier and/or lipid nucleic-acid complex and/or liposome and/or lipid nanoparticle is suitable for administration by injection, e.g., without limitation, subcutaneous injection, intradermal injection, subdermal injection, intramuscular injection, and/or intravenous, intrathecal, intratumoral, intravitreal, subretinal, intracerebroventricular, and/or topical administration and/or infusion. In embodiments, the pharmaceutical composition and/or a lipid aggregate and/or a lipid carrier is suitable for administration as one or more injections containing less than about 10 ng of RNA or about 10 ng to about 2000 ng of RNA.

In aspects, the present invention relates to a method for transfecting a cell with a nucleic acid, comprising contacting the cell with a complex of the nucleic acid and a compound described herein (e.g. of Formulae I-XVI), where the complex of the nucleic acid and the compound described herein (e.g. of Formulae I-XVI) is optionally formed prior to contact with the cell.

In aspects, the present invention relates to a method for reprogramming a differentiated cell to a less differentiated state, comprising (a) providing a differentiated cell; (b) culturing the differentiated cell; and (c) transfecting the differentiated cell with a complex of one or more synthetic RNA molecules and a compound described herein (e.g. of Formulae I-XVI), where the one or more synthetic RNA molecules include at least one RNA molecule encoding one or more reprogramming factors and where the transfection results in the cell expressing the one or more reprogramming factors, to result in the cell being reprogrammed to a less differentiated state. In embodiments, step (c) occurs in the presence of a medium containing ingredients that support reprogramming of the differentiated cell to a less differentiated state. In embodiments, the further comprises repeating step (c) at least twice during 5 consecutive days. In embodiments, the amount of one or more synthetic RNA molecules transfected in one or more later transfections is greater than the amount transfected in one or more earlier transfections. In embodiments, steps (a)-(c) are performed without using feeder cells and occur in the presence of a feeder cell conditioned medium. In embodiments, step (c) is performed without using irradiated human neonatal fibroblast feeder cells and occurs in the presence of a feeder cell conditioned medium. In embodiments, the synthetic RNA molecule encodes one or more reprogramming factor(s) selected from Oct4, Sox2, Klf4, c-Myc, I-Myc, Tert, Nanog, Lin28, Utf1, Aicda, miR200 micro-RNA, miR302 micro-RNA, miR367 micro-RNA, miR369 micro-RNA and biologically active fragments, analogues, variants and family-members thereof.

In aspects, the present invention relates to a method for reprogramming a non-pluripotent cell, comprising (a) providing a non-pluripotent cell; (b) culturing the cell; and (c) transfecting the cell with a complex of one or more synthetic RNA molecules and a compound described herein (e.g. of Formulae I-XVI), where the one or more synthetic RNA molecules include at least one RNA molecule encoding one or more reprogramming factors and where the transfecting results in the cell expressing the one or more reprogramming factors, to result in the cell being reprogrammed. In embodiments, step (c) occurs in the presence of a medium containing ingredients that support reprogramming of the non-pluripotent cell. In embodiments, the further comprises repeating step (c) at least twice during 5 consecutive days. In embodiments, the amount of one or more synthetic RNA molecules transfected in one or more later transfections is greater than the amount transfected in one or more earlier transfections. In embodiments, steps (a)-(c) are performed without using feeder cells and occur in the presence of a feeder cell conditioned medium. In embodiments, step (c) is performed without using irradiated human neonatal fibroblast feeder cells and occurs in the presence of a feeder cell conditioned medium. In embodiments, the synthetic RNA molecule encodes one or more reprogramming factor(s) selected from Oct4, Sox2, Klf4, c-Myc, I-Myc, Tert, Nanog, Lin28, Utf1, Aicda, miR200 micro-RNA, miR302 micro-RNA, miR367 micro-RNA, miR369 micro-RNA and biologically active fragments, analogues, variants and family-members thereof.

In aspects, the present invention relates to a method for gene-editing a cell, comprising transfecting the cell with a complex of one or more synthetic RNA molecules and a compound described herein (e.g. of Formulae I-XVI), where the one or more synthetic RNA molecules include at least one RNA molecule encoding one or more gene-editing proteins selected from a nuclease, a transcription activator-like effector nuclease (TALEN), a zinc-finger nuclease, a meganuclease, a nickase, a gene-editing protein disclosed in WO2014/071219A1, the entirety of which is incorporated herein by reference, a clustered regularly interspaced short palindromic repeat (CRISPR)-associated protein, CRISPR/Cas9, Cas9, xCas9, Cas12a (Cpf1), Cas13a, Cas14, CasX, CasY, a Class 1 Cas protein, a Class 2 Cas protein, and MAD7, or a natural or engineered variant, family-member, orthologue, fragment or fusion construct thereof.

In aspects, the present invention relates to a method for reprogramming and/or gene-editing a cell, comprising contacting the cell with a complex of the nucleic acid and a compound described herein (e.g. of Formulae I-XVI) and/or a compound disclosed in US2009/0143583A1, the entirety of which is incorporated herein by reference.

In aspects, the present invention relates to a pharmaceutical formulation comprising a nucleic acid of the present invention and a compound described herein (e.g. of Formulae I-XVI) and/or a compound disclosed in US2009/0143583A1, the entirety of which is incorporated herein by reference.

In embodiments, the new lipids are useful for delivery of vaccines. In aspects, the present invention relates to a method of vaccinating against an infectious disease (without limitation a coronavirus infection, e.g. COVID-19) comprising contacting the cell with a complex of the nucleic acid encoding an antigen of the infectious agent and a compound described herein (e.g. of Formulae I-XVI).

In aspects, the present invention relates to a method for extracting an organic compound from a reaction containing lithium aluminum hydride and a solvent comprising: (a) quenching the reaction with water; (b) removing the solvent; (c) removing excess water; and (d) extracting the organic compound with an alcohol (optionally isopropyl alcohol); to yield an extracted organic compound.

In aspects, the present invention relates to a method for extracting an organic compound from a reaction containing a water-reactive compound and a first solvent comprising: (a) quenching the reaction with water; (b) removing the first solvent; (c) removing excess water; and (d) extracting the organic compound with a second solvent; to yield an extracted organic compound.

In aspects, the present invention relates to a method for purifying an organic compound from a mixture of the organic compound and a phthalimide or phthalimide derivative (optionally phthalhydrazide) comprising: (a) dissolving the mixture in acetone to form a precipitate; (b) removing the precipitate by centrifugation; and (c) removing the acetone; to yield a purified organic compound.

The details of the invention are set forth in the accompanying description below. Although methods and materials similar or equivalent to those described herein can be used in the practice or testing of the present invention, illustrative methods and materials are now described. Other features, objects, and advantages of the invention will be apparent from the description and from the claims. In the specification and the appended claims, the singular forms also include the plural unless the context clearly dictates otherwise. Unless defined otherwise, all technical and scientific terms used herein have the same meaning as commonly understood by one of ordinary skill in the art to which this invention belongs.

Any aspect or embodiment disclosed herein can be combined with any other aspect or embodiment as disclosed herein.

DETAILED DESCRIPTION OF THE FIGURES

FIG. 1 depicts primary human epidermal keratinocytes cultured in a 24-well plate, and transfected with 400 ng per well of in vitro transcribed RNA encoding green fluorescent protein (GFP) complexed with the indicated lipid and with the indicated mass ratio of lipid to RNA. Complexation was performed in DMEM, and transfections were performed in 100% fetal bovine serum (FBS). Images were taken eight hours following transfection.

FIG. 2 depicts the experiment of FIG. 1, with florescence measured at the indicated time points following transfection using DHDLinS.

FIG. 3 depicts the results of an experiment conducted as in FIG. 1, but with the indicated amounts of RNA (in nanograms) and the indicated lipid-to-RNA mass ratios (in micrograms of lipid per microgram of RNA). Images were taken 16 hours following transfection. As shown in the figure, all RNA amounts and lipid-to-RNA mass ratios tested yielded a fluorescent signal.

Figure 10:
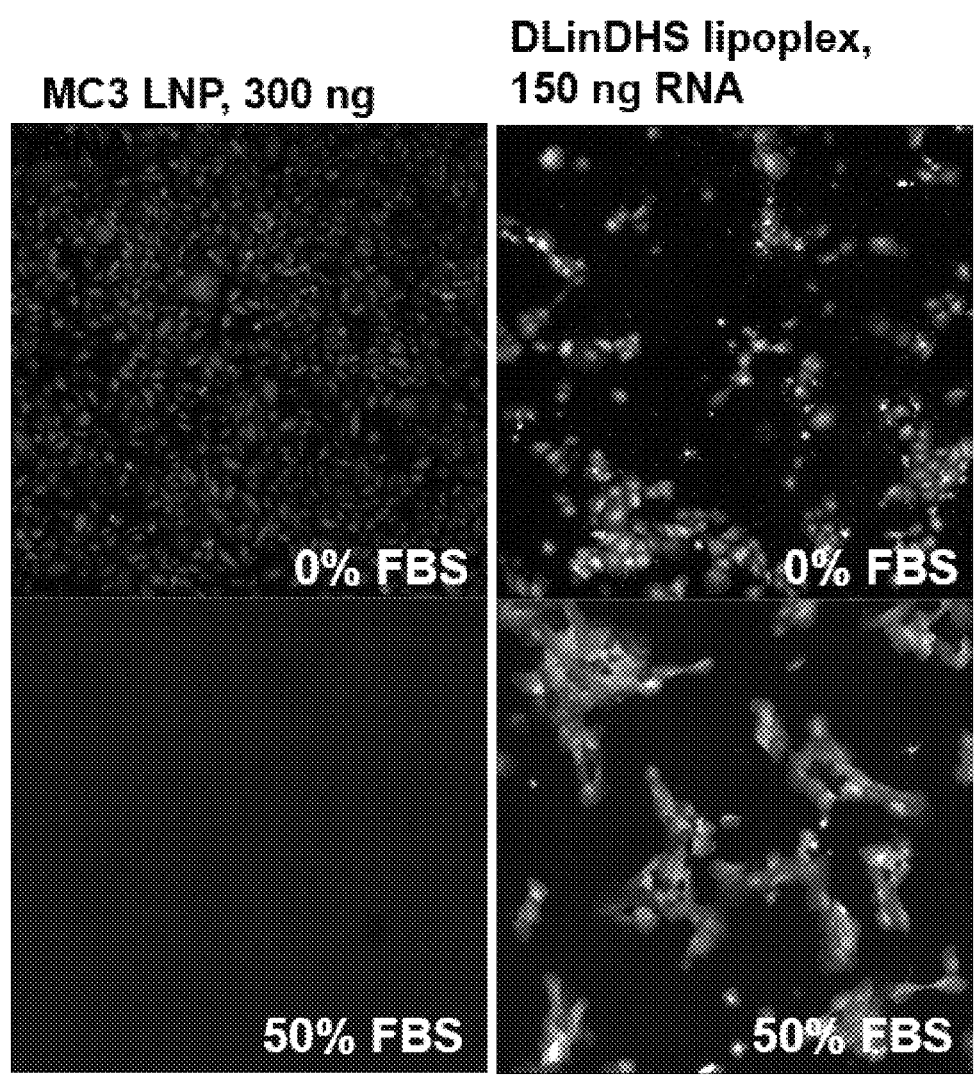

FIG. 10 depicts the results of an experiment in which primary human epidermal keratinocytes were transfected with in vitro transcribed RNA encoding GFP and complexed with DLinDHS. The RNA-DLinDHS complexes were added to 20,000 human epidermal keratinocytes in serum-free medium (0% fetal bovine serum (FBS) or 50% FBS. Images were taken 16 hours following transfection. "MC3 LNP" denotes cells transfected using GFP RNA formulated using a microfluidic device into lipid nanoparticles composed of DLin-MC3-DMA, DOPE, cholesterol, and DMPE-PEG in a molar ratio of 30:30:38.5:1.5.

Figure 11A:
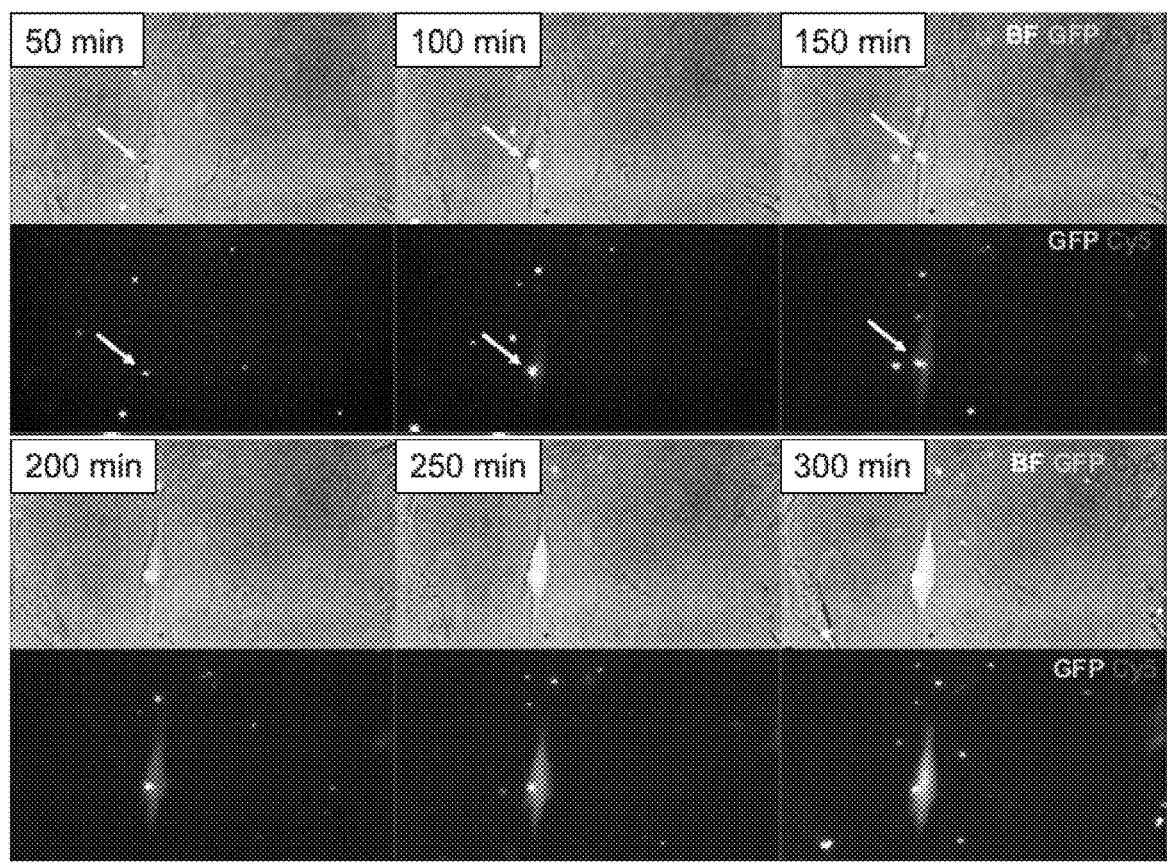

FIG. 11A illustrates the results of an experiment in which primary human dermal fibroblasts were transfected with in vitro transcribed RNA encoding GFP and complexed with DLinDHS. Of the GFP-encoding RNA, 20% was labeled with CyS. The RNA-DLinDHS complexes were added to 20,000 human dermal fibroblasts in 10% FBS. Images were taken 50 minutes, 100 minutes, 150 minutes, 200 minutes, 250 minutes, and 300 minutes following transfection.

Figure 11B:
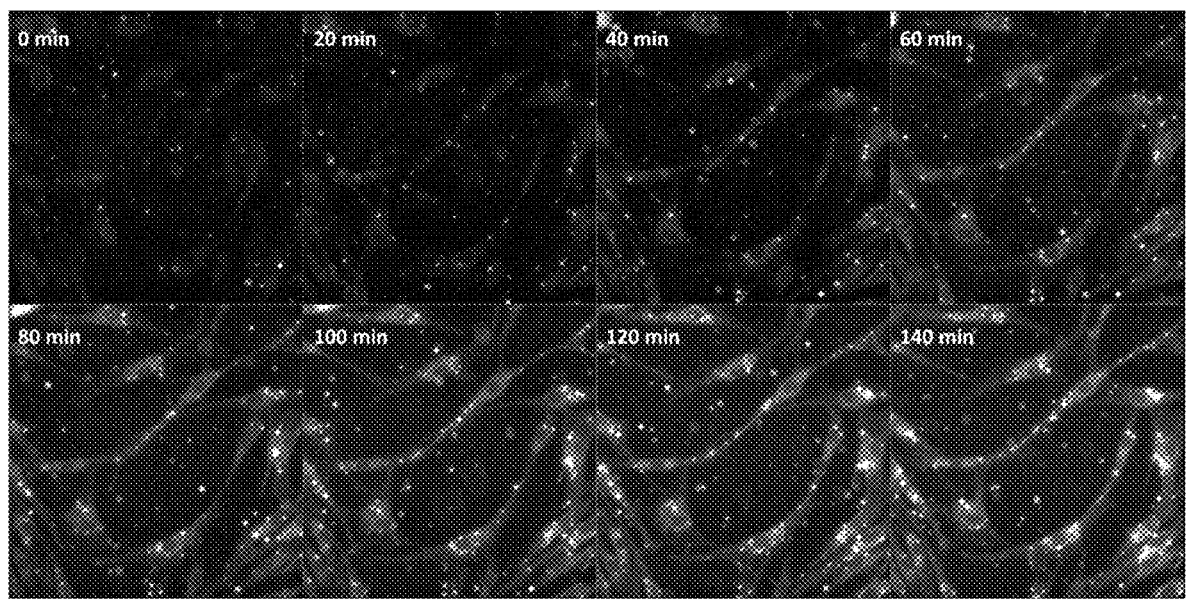

FIG. 11B illustrates the results of an experiment in which primary human dermal fibroblasts were transfected with in vitro transcribed RNA encoding GFP and complexed with DLinDHS. Of the DLinDHS, 10% was labeled with a BODIPY fluorescent tag. The RNA-DLinDHS complexes were added to 20,000 human dermal fibroblasts in 10% FBS. Images were taken in the BODIPY channel at the time of transfection ("0 min"), and at 20 minutes, 40 minutes, 60 minutes, 80 minutes, 100 minutes, 120 minutes, and 140 minutes following transfection.

Figure 12:
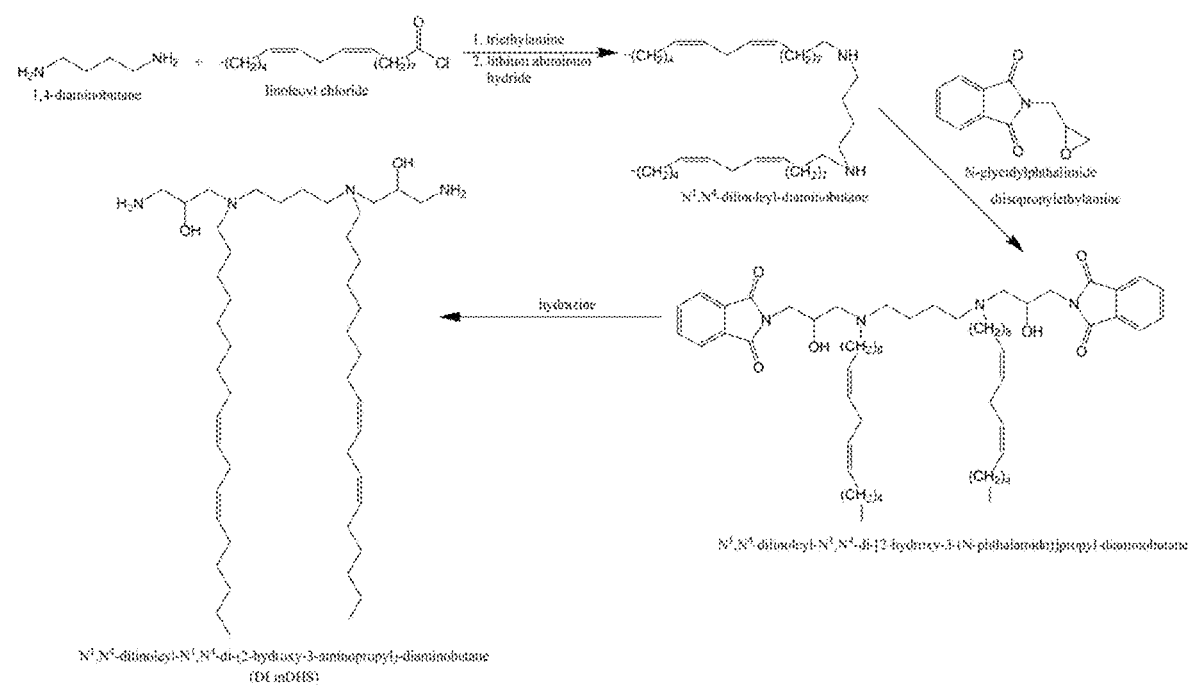

FIG. 12 illustrates a schematic of a synthesis of DLinDHS.

Figure 13:
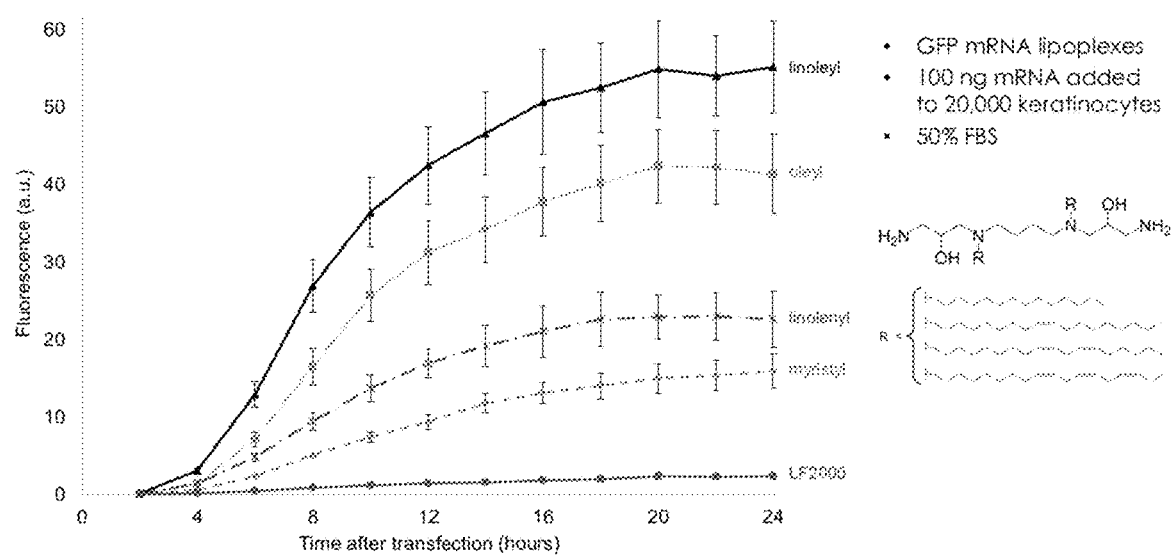

FIG. 13 illustrates the results of an experiment in which primary human epidermal keratinocytes were transfected with in vitro transcribed RNA encoding GFP and complexed with compounds of the invention, comprising a dihydroxyspermine headgroup conjugated to different fatty-acid derived tails, including myristyl, oleyl, linoleyl, and linolenyl. The graph illustrates fluorescence (a.u.) versus the time after transfection (hours) for the studied complexes and for RNA complexed with LIPOFECTAMINE 2000.

Figure 14:
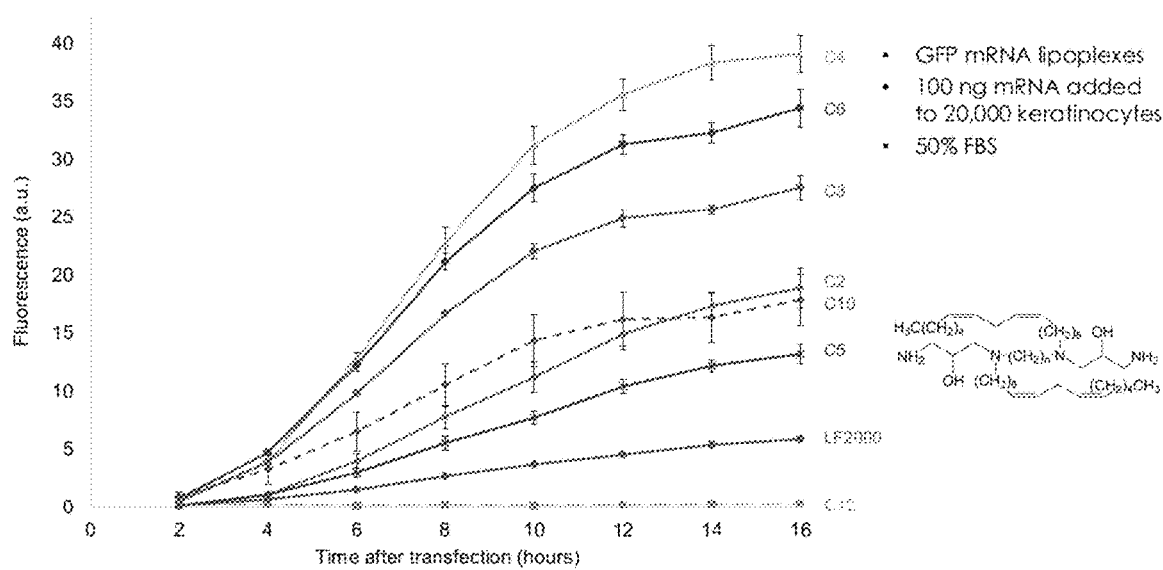

FIG. 14 illustrates the results of an experiment in which primary human epidermal keratinocytes were transfected with in vitro transcribed RNA encoding GFP and complexed with compounds of the invention, comprising a dilinoleyl fatty-acid derived tail structure. The tested compounds' structure is a bis-(2-hydroxy-3-aminopropyl)-N,N'-dilinoleyl-diamine as shown, with the labels indicating the length of the central inter-amino carbon chain of the headgroup (n on the structure). The graph illustrates fluorescence (a.u.) versus the time after transfection (hours) for the studied complexes and for RNA complexed with LIPOFECTAMINE 2000.

Figure 15:
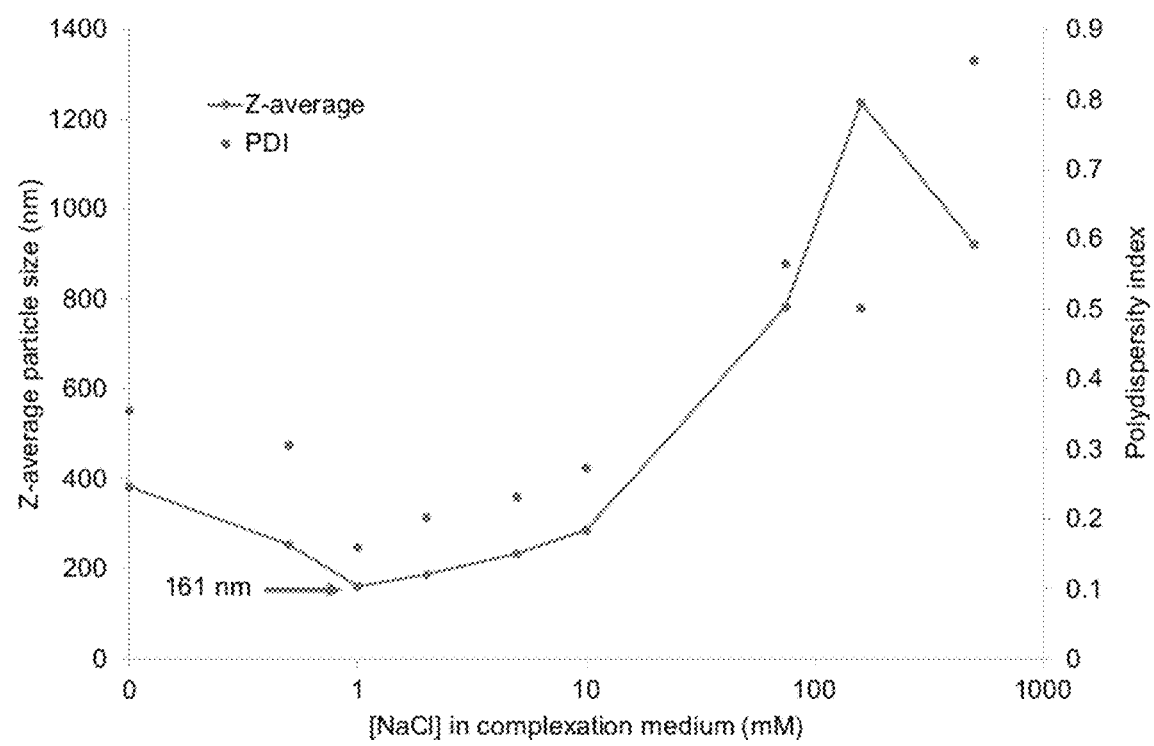

FIG. 15 depicts a graph illustrating a Z-average particle size (nm) and polydispersity index (PDI) of several DLinDHS/RNA complexes, versus ionic strength ([NaCl], mM) of complexation medium. Complexes were formed by diluting lipid into complexation medium, an aqueous RNA solution having the indicated ionic strength.

Figure 16:
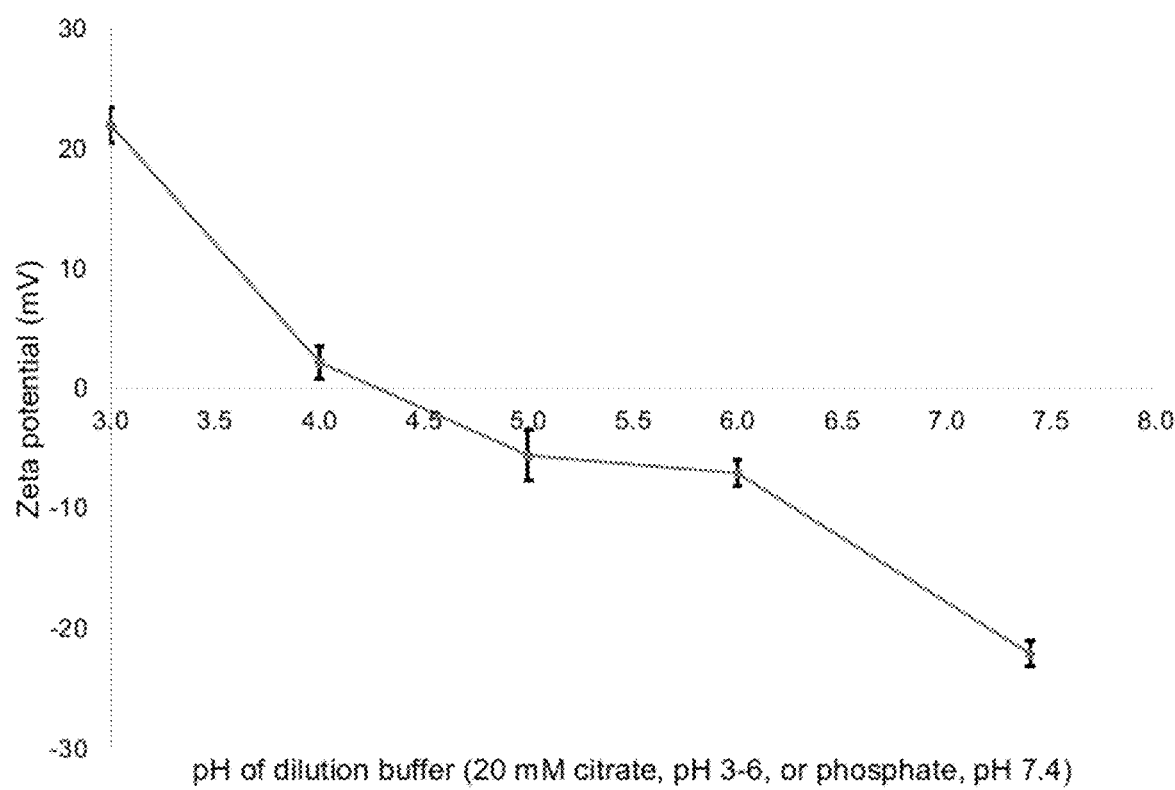

FIG. 16 depicts a graph illustrating zeta potential (mV) of DLinDHS/RNA complexes diluted into 20 mM buffer titrated to the indicated pH.

Figure 17:
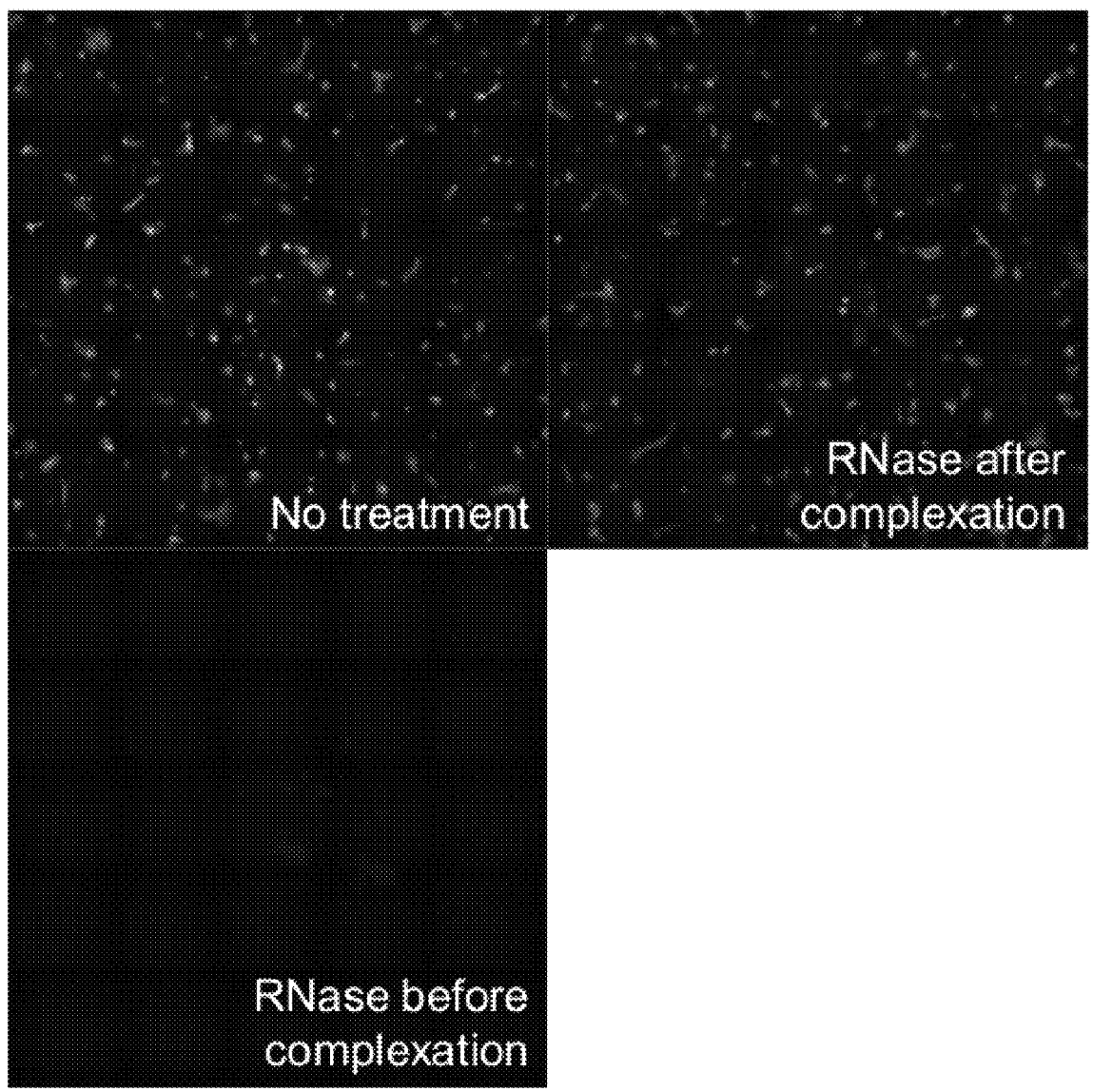

FIG. 17 illustrates images of DLinDHS/RNA complexes without treatment with RNase A ("No treatment"), DLinDHS/RNA complexes treated with RNase A after complexation ("RNase after complexation"), and DLinDHS complexed with RNA treated with RNase A prior to complexation ("RNase before complexation").

Figure 18:
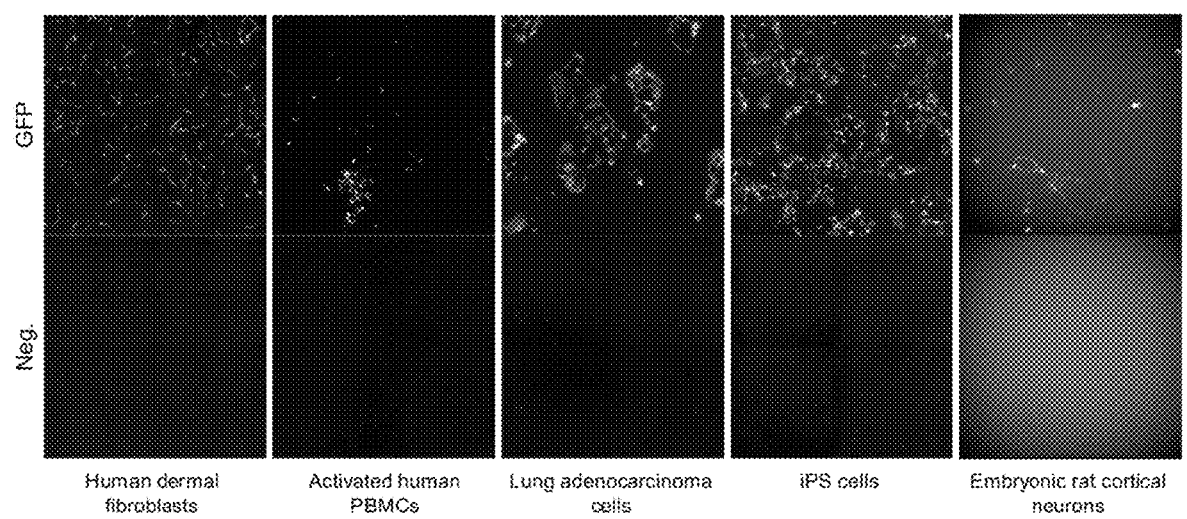

FIG. 18 illustrates the results of transfection of in vitro transcribed RNA encoding GFP, complexed with DLinDHS in primary human dermal fibroblasts, activated human peripheral blood mononuclear cells (PBMCs), human lung adenocarcinoma cells, pluripotent stem cells (iPS cells), and rat embryonic cortical neurons.

Figure 19:
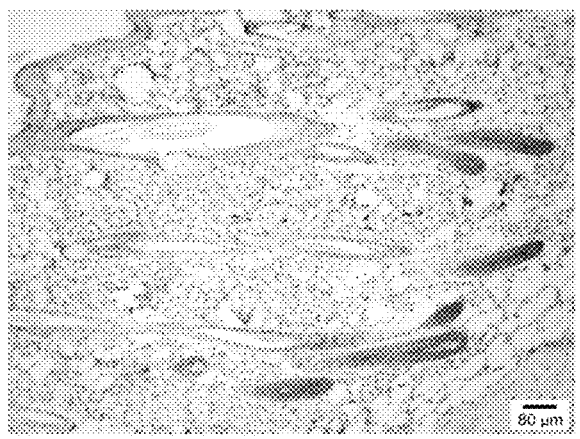
Figure 19:
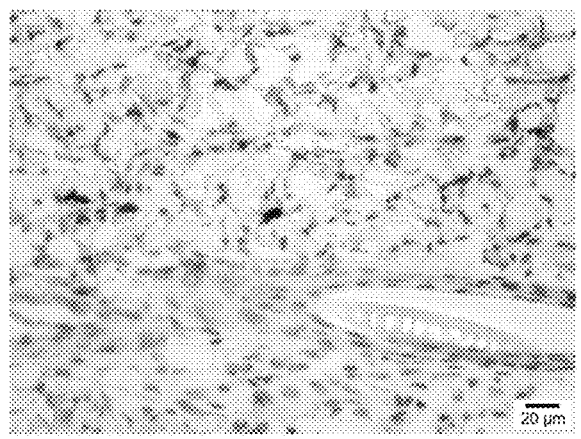

FIG. 19 depicts the results of an experiment in which in vitro transcribed RNA was complexed with DLinDHS and administered to rat by intradermal injection. Tissue at the injection site was fixed and mounted on slides, then stained with hematoxylin (blue) and rabbit anti-GFP antibody (brown). Two different magnifications of the same tissue are shown.

Figure 20A:
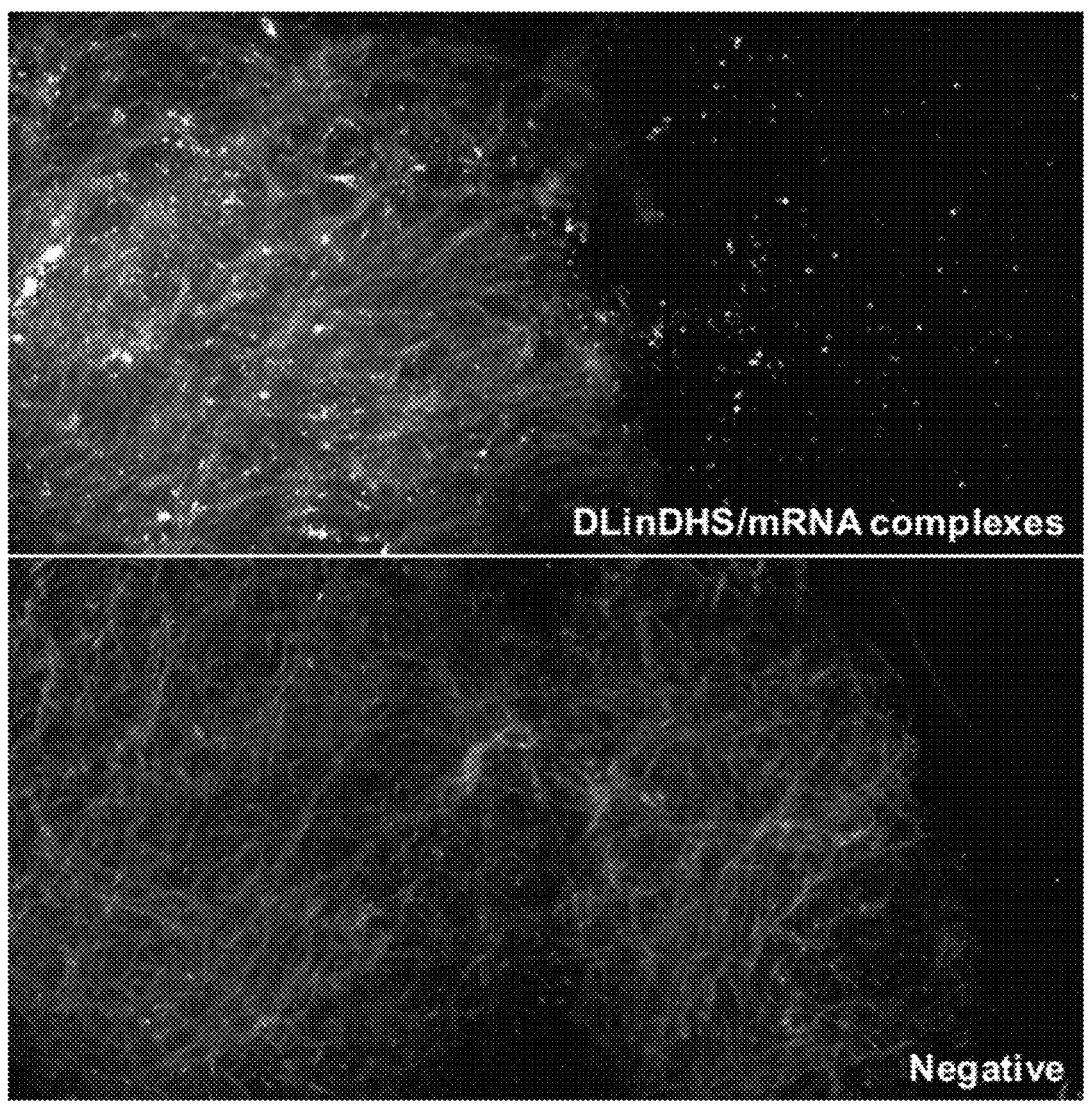

FIG. 20A depicts biopsied human skin imaged by fluorescent confocal microscopy, 48 hours after RNA encoding GFP, complexed with DLinDHS, was administered by intradermal injection.

Figure 20B:
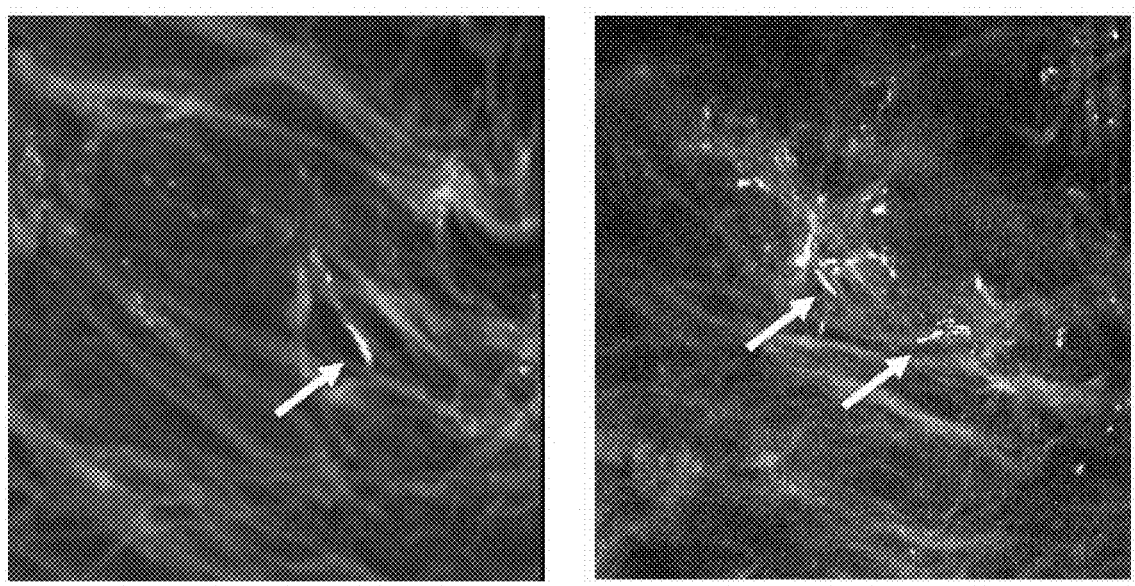

FIG. 20B depicts the results of an experiment of in vivo mRNA delivery to a human subject by intradermal injection.

DETAILED DESCRIPTION OF THE INVENTION

The present invention is based, in part, on the discovery of novel lipids that, inter alia, demonstrate superior abilities to support delivery of nucleic acids to cells, e.g. during transfection. The present invention provides such compositions, methods of making the compositions, and methods of using the compositions to introduce nucleic acids into cells, including for the treatment of diseases.

Compounds and Synthetic Methods

In aspects, the present invention relates to a compound of Formula (I)

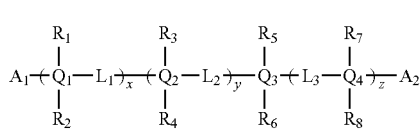

wherein: $Q_1$, $Q_2$, $Q_3$, and $Q_4$ are independently an atom or group capable of adopting a positive charge;

$A_1$ and $A_2$ are independently null, H, or optionally substituted $C_1$-$C_6$ alkyl;

$L_1$, $L_2$, and $L_3$ are independently null, a bond, $(C_1$-$C_{20})$ alkanediyl, (halo)($C_1$-$C_{20}$)alkanediyl, (hydroxy)($C_1$-$C_{20}$)alkanediyl, (alkoxy)($C_1$-$C_{20}$)alkanediyl, arylene, heteroarylene, cycloalkanediyl, heterocycle-diyl, or any combination of the aforementioned optionally linked by one or more of an ether, an ester, an anhydride, an amide, a carbamate, a secondary amine, a tertiary amine, a quaternary ammonium, a thioether, a urea, a carbonyl, or an imine;

$R_1$, $R_2$, $R_3$, $R_4$, $R_5$, $R_6$, $R_7$, and $R_8$ are independently null, H, $(C_1$-$C_{60})$alkyl, (halo)($C_1$-$C_{60}$)alkyl, (hydroxy)($C_1$-$C_{60}$)alkyl, (alkoxy)($C_1$-$C_{60}$)alkyl, $(C_2$-$C_{60})$alkenyl, (halo)($C_2$-$C_{60}$)alkenyl, (hydroxy)($C_2$-$C_{60}$)alkenyl, (alkoxy)($C_2$-$C_{60}$)alkenyl, $(C_2$-$C_{60})$alkynyl, (halo)($C_2$-$C_{60}$)alkynyl, (hydroxy)($C_2$-$C_{60}$)alkynyl, (alkoxy)($C_2$-$C_{60}$)alkynyl, wherein at least one of $R_1$, $R_2$, $R_3$, $R_4$, $R_5$, $R_6$, $R_7$, and $R_8$ comprises at least two unsaturated bonds; and x, y, and z are independently 0, 1, 2, 3, 4, 5, 6, 7, 8, 9, 10, 11, 12, 13, 14, or 15.

In embodiments, $Q_1$, $Q_2$, $Q_3$, and $Q_4$ independently are N, B, P, or Fe.

In embodiments, $Q_1$, $Q_2$, $Q_3$, and $Q_4$ are N.

In embodiments, $Q_1$, $Q_2$, $Q_3$, and $Q_4$ are independently a primary amine, a secondary amine, or a tertiary amine.

In embodiments, $Q_1$ and $Q_4$ are primary amines, and $Q_2$ and $Q_3$ are tertiary amines.

In embodiments, $L_1$, $L_2$, and $L_3$ are independently $(C_1$-$C_6)$alkanediyl or (hydroxy)($C_1$-$C_6$)alkanediyl.

In embodiments, $L_1$ and $L_3$ are independently (hydroxy)($C_1$-$C_6$)alkanediyl and $L_2$ is $(C_1$-$C_6)$alkanediyl.

In embodiments, $L_1$ and $L_3$ are 2-hydroxypropanediyl and $L_2$ is $(C_1$-$C_6)$alkanediyl.

In embodiments, $L_1$ and $L_3$ are 2-hydroxypropanediyl and $L_2$ is butanediyl.

In embodiments, one or more of $R_1$, $R_2$, $R_3$, $R_4$, $R_5$, $R_6$, $R_7$, and $R_8$ are independently selected from H, linoleyl, alpha-linolenyl, gamma-linolenyl, linoelaidyl, arachidonyl, eicosapentaenyl, and docosahexaenyl.

In embodiments, two or more of $R_1$, $R_2$, $R_3$, $R_4$, $R_5$, $R_6$, $R_7$, and $R_8$ are independently selected from H, linoleoyl, alpha-linolenoyl, gamma-linolenoyl, linoelaidoyl, arachidonoyl, eicosapentaenoyl, and docosahexaenoyl.

In embodiments, one or more of $R_1$, $R_2$, $R_3$, $R_4$, $R_5$, $R_6$, $R_7$, and $R_8$ are independently selected from H, myristoleyl, palmitoleyl, sapienyl, oleyl, elaidyl, vaccenyl, erucyl, caprylyl, capryl, lauryl, myristyl, palmityl, stearyl, arachidyl, behenyl, lignoceryl, and cerotyl.

In embodiments, two or more of $R_1$, $R_2$, $R_3$, $R_4$, $R_5$, $R_6$, $R_7$, and $R_8$ are independently selected from H, myristoleoyl, palmitoleoyl, sapienoyl, oleoyl, elaidoyl, vaccenoyl, erucoyl, capryloyl, caproyl, lauroyl, myristoyl, palmitoyl, stearoyl, arachidoyl, behenoyl, lignoceroyl, and cerotoyl.

In embodiments, $R_1$, $R_2$, $R_3$, $R_5$, $R_7$ and $R_8$ are H and $R_4$ and $R_6$ are independently selected from linoleyl, alpha-linolenyl, gamma-linolenyl, linoelaidyl, arachidonyl, eicosapentaenyl, and docosahexaenyl.

In embodiments, $R_1$, $R_2$, $R_3$, $R_5$, $R_7$ and $R_8$ are H and $R_4$ and $R_6$ are alpha-linolenyl.

In embodiments, $R_1$, $R_2$, $R_3$, $R_5$, $R_7$ and $R_8$ are H and $R_4$ and $R_6$ are linoleyl.

In embodiments, x and z are independently 0 or 1, and y is 1.

In embodiments, $Q_1$ and $Q_4$ are primary amines; $Q_2$ and $Q_3$ are tertiary amines; $L_1$ and $L_3$ are 2-hydroxypropanediyl; $L_2$ is butanediyl; $R_1$, $R_2$, $R_3$, $R_5$, $R_7$ and $R_8$ are H and $R_4$ and $R_6$ are linoleyl; and x, y, and z are 1.

In embodiments, one or more of $L_1$, $L_2$, and $L_3$ comprises at least one ester moiety.

In embodiments, one or more of $R_2$ and $R_4$ comprises at least one ester moiety.

In embodiments, $A_1$ and $A_2$ are H.

In aspects, the present invention relates to a compound of Formula (II)

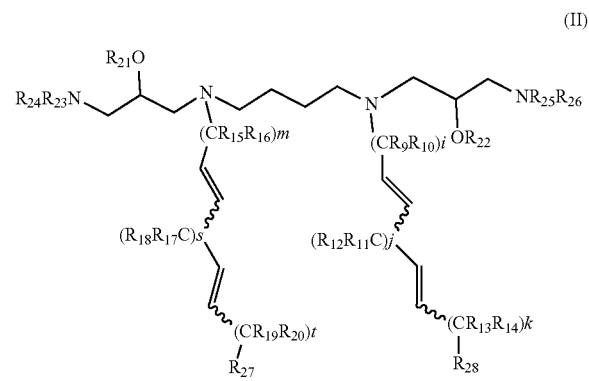

wherein: $R_9$, $R_{10}$, $R_{11}$, $R_{12}$, $R_{13}$, $R_{14}$, $R_{15}$, $R_{16}$, $R_{17}$, $R_{18}$, $R_{19}$, $R_{20}$, $R_{21}$, $R_{22}$, $R_{23}$, $R_{24}$, $R_{25}$, $R_{26}$, $R_{27}$, and $R_{28}$ are independently H, halo, OH, $(C_1$-$C_6)$alkyl, (halo)($C_1$-$C_6$)alkyl, (hydroxy)($C_1$-$C_6$)alkyl, (alkoxy)($C_1$-$C_6$)alkyl, aryl, heteroaryl, cycloalkyl, or heterocyclo;

j, k, m, s, and t are independently 0, 1, 2, 3, 4, 5, 6, 7, 8, 9, 10, 11, 12, 13, 14, or 15.

In embodiments, $R_{15}$, $R_{16}$, $R_{17}$, $R_{18}$, $R_{19}$, and $R_{20}$ are H; $R_9$, $R_{10}$, $R_{11}$, $R_{12}$, $R_{13}$ and $R_{14}$ are independently H or $(C_1$-$C_6)$alkyl; m is 8; i is 8; s is 1; j is 1; k is 4; and t is 4.

In embodiments, $R_{15}$, $R_{16}$, $R_{17}$, $R_{18}$, $R_{19}$, and $R_{20}$ are H; $R_9$, $R_{10}$, $R_{11}$, $R_{12}$, $R_{13}$ and $R_{14}$ are independently H or $(C_1$-$C_6)$alkyl; $R_{27}$ and $R_{28}$ are methyl; m is 8; i is 8; s is 1; j is 1; k is 4; and t is 4.

In embodiments, $R_{15}$, $R_{16}$, $R_{17}$, $R_{18}$, $R_{19}$, and $R_{20}$ are H; $R_9$, $R_{10}$, $R_{11}$, $R_{12}$, $R_{13}$ and $R_{14}$ are independently H; $R_{27}$ and $R_{28}$ are methyl; m is 8; i is 8; s is 1; j is 1; k is 4; and t is 4.

In embodiments, $R_{15}$, $R_{16}$, $R_{17}$, $R_{18}$, $R_{19}$, and $R_{20}$ are H; $R_9$, $R_{10}$, $R_{11}$, $R_{12}$, $R_{13}$ and $R_{14}$ are independently H; $R_{27}$ and $R_{28}$ are methyl; $R_{21}$, $R_{22}$, $R_{23}$, $R_{24}$, $R_{25}$, and $R_{26}$ are H; m is 8; i is 8; s is 1; j is 1; k is 4; and t is 4.

In embodiments, $R_{15}$, $R_{16}$, $R_{17}$, $R_{18}$, $R_{19}$, and $R_{20}$ are H; $R_9$, $R_{10}$, $R_{11}$, $R_{12}$, $R_{13}$ and $R_{14}$ are independently H; $R_{27}$ and $R_{28}$ are methyl; $R_{21}$, $R_{22}$, $R_{23}$, $R_{24}$, $R_{25}$, and $R_{26}$ are H; m is 9; i is 9; s is 1; j is 1; k is 4; and t is 4.

In embodiments, $R_{15}$, $R_{16}$, $R_{17}$, $R_{18}$, $R_{19}$, and $R_{20}$ are H; $R_9$, $R_{10}$, $R_{11}$, $R_{12}$, $R_{13}$ and $R_{14}$ are independently H; $R_{27}$ and $R_{28}$ are methyl; $R_{21}$, $R_{22}$, $R_{23}$, $R_{24}$, $R_{25}$, and $R_{26}$ are H; m is 9; i is 9; s is 1; j is 1; k is 3; and t is 3.

In aspects, the present invention relates to a compound of Formula (III):

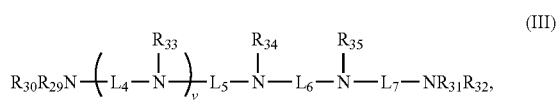

(III)

wherein $L_4$, $L_5$, $L_6$, and $L_7$ are independently a bond, $(C_1$-$C_{20})$alkanediyl, (halo)$(C_1$-$C_{20})$alkanediyl, (hydroxy)$(C_1$-$C_{20})$alkanediyl, (alkoxy)$(C_1$-$C_{20})$alkanediyl, arylene, heteroarylene, cycloalkanediyl, heterocycle-diyl, $-(CH_2)_{v1}-C(O)-$, or $-((CH_2)_{v1}-O)_{v2}-$, or $-((CH_2)_{v1}-C(O)-O)_{v2}-$, $R_{29}$, $R_{30}$, $R_{31}$, $R_{32}$, $R_{33}$, $R_{34}$, and $R_{35}$ are independently H, $(C_1$-$C_{60})$alkyl, (halo)$(C_1$-$C_{60})$alkyl, (hydroxy)$(C_1$-$C_{60})$alkyl, (alkoxy)$(C_1$-$C_{60})$alkyl, $(C_2$-$C_{60})$alkenyl, (halo)$(C_2$-$C_{60})$alkenyl, (hydroxy)$(C_2$-$C_{60})$alkenyl, (alkoxy)$(C_2$-$C_{60})$alkenyl, $(C_2$-$C_{60})$alkynyl, (halo)$(C_2$-$C_{60})$alkynyl, (hydroxy)$(C_2$-$C_{60})$alkynyl, (alkoxy)$(C_2$-$C_{60})$alkynyl, wherein at least one of $R_{29}$, $R_{30}$, $R_{31}$, $R_{32}$, $R_{33}$, $R_{34}$, and $R_{35}$ comprises at least two unsaturated bonds;

v, $v_1$ and $v_2$ are independently 0, 1, 2, 3, 4, 5, 6, 7, 8, 9, 10, 11, 12, 13, 14, or 15.

In embodiments, $L_4$, $L_5$, $L_6$, and $L_7$ are $-(CH_2)_3-$; $R_{29}$, $R_{30}$, $R_{31}$, $R_{32}$, $R_{33}$, $R_{34}$, and $R_{35}$ are independently H or $(C_2$-$C_{60})$alkenyl; v is 1; wherein at least two of $R_{29}$, $R_{30}$, $R_{31}$, $R_{32}$, $R_{33}$, $R_{34}$, and $R_{35}$ comprise at least two unsaturated bonds.

In embodiments, $L_4$ and $L_5$ are $-(CH_2)_3-$; $L_6$ and $L_7$ are $-(CH_2)_4-$, $R_{29}$, $R_{30}$, $R_{31}$, $R_{32}$, $R_{33}$, $R_{34}$, and $R_{35}$ are independently H or $(C_2$-$C_{60})$alkenyl; v is 1; wherein at least two of $R_{29}$, $R_{30}$, $R_{31}$, $R_{32}$, $R_{33}$, $R_{34}$, and $R_{35}$ comprise at least two unsaturated bonds.

In embodiments, $L_4$ and $L_6$ are $-(CH_2)_3-$; $L_5$ and $L_7$ are $-(CH_2)_4-$, $R_{29}$, $R_{30}$, $R_{31}$, $R_{32}$, $R_{33}$, $R_{34}$, and $R_{35}$ are independently H or $(C_2$-$C_{60})$alkenyl; v is 1; wherein at least two of $R_{29}$, $R_{30}$, $R_{31}$, $R_{32}$, $R_{33}$, $R_{34}$, and $R_{35}$ comprise at least two unsaturated bonds.

In embodiments, $L_4$ and $L_7$ are $-(CH_2)_3-$; $L_5$ and $L_6$ are $-(CH_2)_4-$; $R_{29}$, $R_{30}$, $R_{31}$, $R_{32}$, $R_{33}$, $R_{34}$, and $R_{35}$ are independently H or $(C_2$-$C_{60})$alkenyl; v is 1; wherein at least two of $R_{29}$, $R_{30}$, $R_{31}$, $R_{32}$, $R_{33}$, $R_{34}$, and $R_{35}$ comprise at least two unsaturated bonds.

In embodiments, $L_4$ and $L_6$ are $-(CH_2)_3-$; $L_5$ and $L_7$ are $-(CH_2)_5-$, $R_{29}$, $R_{30}$, $R_{31}$, $R_{32}$, $R_{33}$, $R_{34}$, and $R_{35}$ are independently H or $(C_2$-$C_{60})$alkenyl; v is 1; wherein at least two of $R_{29}$, $R_{30}$, $R_{31}$, $R_{32}$, $R_{33}$, $R_{34}$, and $R_{35}$ comprise at least two unsaturated bonds.

In embodiments, $L_4$ and $L_7$ are (hydroxy)$(C_1$-$C_{20})$alkanediyl; $L_5$ and $L_6$ are $-(CH_2)_3-$; $R_{29}$, $R_{30}$, $R_{31}$, $R_{32}$, $R_{33}$, $R_{34}$, and $R_{35}$ are independently H or $(C_2$-$C_{60})$alkenyl; v is 1; wherein at least two of $R_{29}$, $R_{30}$, $R_{31}$, $R_{32}$, $R_{33}$, $R_{34}$, and $R_{35}$ comprise at least two unsaturated bonds.

In embodiments, $L_4$ and $L_7$ are (hydroxy)$(C_1$-$C_{20})$alkanediyl; $L_5$ and $L_6$ are $-(CH_2)_3-$; $R_{29}$, $R_{30}$, $R_{31}$, $R_{32}$, $R_{33}$, $R_{34}$, and $R_{35}$ are independently H or $(C_2$-$C_{60})$alkenyl; v is 1; wherein at least three of $R_{29}$, $R_{30}$, $R_{31}$, $R_{32}$, $R_{33}$, $R_{34}$, and $R_{35}$ comprise at least two unsaturated bonds.

In embodiments, $L_4$ and $L_7$ are (hydroxy)$(C_1$-$C_{20})$alkanediyl; $L_5$ and $L_6$ are $-(C_1$-$C_{12})_4-$; $R_{29}$, $R_{30}$, $R_{31}$, $R_{32}$, $R_{33}$, $R_{34}$, and $R_{35}$ are independently H or $(C_2$-$C_{60})$alkenyl; v is 1; wherein at least three of $R_{29}$, $R_{30}$, $R_{31}$, $R_{32}$, $R_{33}$, $R_{34}$, and $R_{35}$ comprise at least two unsaturated bonds.

In embodiments, $L_4$ and $L_7$ are (hydroxy)$(C_1$-$C_{20})$alkanediyl; $L_5$ and $L_6$ are $-(CH_2)_5-$, $R_{23}$, $R_{30}$, $R_{31}$, $R_{32}$, $R_{33}$, $R_{34}$, and $R_{35}$ are independently H or $(C_2$-$C_{60})$alkenyl; v is 1; wherein at least three of $R_{23}$, $R_{30}$, $R_{31}$, $R_{32}$, $R_{33}$, $R_{34}$, and $R_{35}$ comprise at least two unsaturated bonds.

In embodiments, $L_4$ and $L_7$ are (hydroxy)$(C_1$-$C_{20})$alkanediyl; $L_5$ and $L_6$ are $-(CH_2)_6-$, $R_{23}$, $R_{30}$, $R_{31}$, $R_{32}$, $R_{33}$, $R_{34}$, and $R_{35}$ are independently H or $(C_2$-$C_{60})$alkenyl; v is 1; wherein at least three of $R_{23}$, $R_{30}$, $R_{31}$, $R_{32}$, $R_{33}$, $R_{34}$, and $R_{35}$ comprise at least two unsaturated bonds.

In embodiments, two or more of $R_{23}$, $R_{30}$, $R_{31}$, $R_{32}$, $R_{33}$, $R_{34}$, and $R_{35}$ are independently selected from H, myristoleoyl, palmitoleoyl, sapienoyl, oleoyl, elaidoyl, vaccenoyl, erucoyl, capryloyl, caproyl, lauroyl, myristoyl, palmitoyl, stearoyl, arachidoyl, behenoyl, lignoceroyl, and cerotoyl.

In embodiments, two or more of $R_{23}$, $R_{30}$, $R_{31}$, $R_{32}$, $R_{33}$, $R_{34}$, and $R_{35}$ are independently selected from H, linoleyl, alpha-linolenyl, gamma-linolenyl, linoelaidyl, arachidonyl, eicosapentaenyl, and docosahexaenyl.

In embodiments, $L_4$ and $L_7$ are 2-hydroxypropanediyl; $L_2$ is butanediyl; $R_{23}$, $R_{30}$, $R_{31}$, and $R_{32}$ are H, $R_{33}$, $R_{34}$, and $R_{35}$ are linoleyl; $L_5$ and $L_6$ are $-(CH_2)_3-$; and v is 1.

In embodiments, $L_4$ and $L_7$ are 2-hydroxypropanediyl; $L_2$ is butanediyl; $R_{23}$, $R_{30}$, $R_{31}$, and $R_{32}$ are H, $R_{33}$, $R_{34}$, and $R_{35}$ are linoleyl; $L_5$ and $L_6$ are $-(CH_2)_4-$; and v is 1.

In embodiments, $L_4$ and $L_7$ are 2-hydroxypropanediyl; $L_2$ is butanediyl; $R_{23}$, $R_{30}$, $R_{31}$, and $R_{32}$ are H, $R_{33}$, $R_{34}$, and $R_{35}$ are linoleyl; $L_5$ and $L_6$ are $-(CH_2)_5-$; and v is 1.

In embodiments, $L_4$ and $L_7$ are 2-hydroxypropanediyl; $L_2$ is butanediyl; $R_{23}$, $R_{30}$, $R_{31}$, and $R_{32}$ are H, $R_{33}$, $R_{34}$, and $R_{35}$ are linoleyl; $L_5$ and $L_6$ are $-(CH_2)_6-$; and v is 1.

In embodiments, the present invention relates to a compound of Formula (IV):

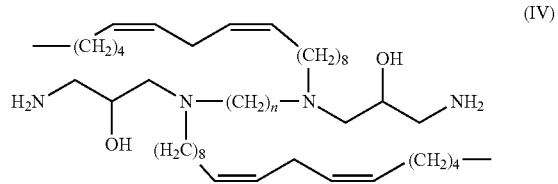

(IV)

wherein n is 1, 2, 3, 4, 5, 6, 7, 8, 9, 10, 11, 12, 13, 14, or 15.

In embodiments, the present invention relates to a compound of Formula (V):

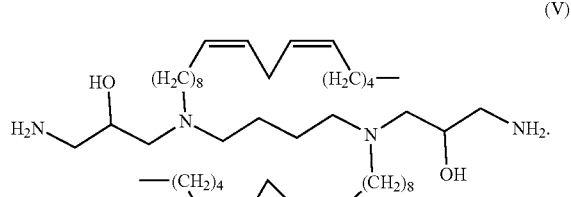

(V)

In embodiments, the present invention relates to a compound of Formula (VI):

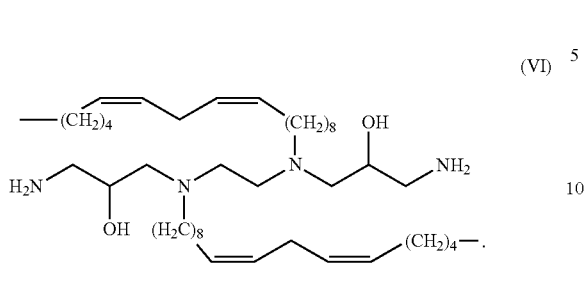
(VI)

In embodiments, the present invention relates to a compound of Formula (VII):

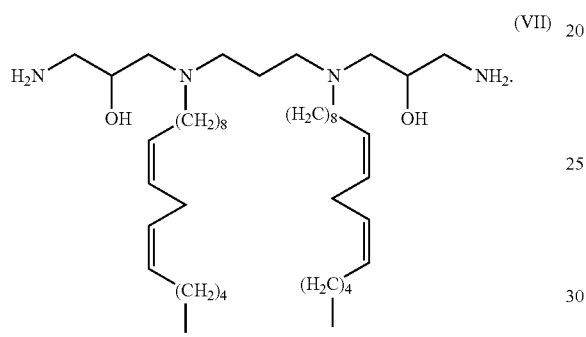
(VII)

In embodiments, the present invention relates to a compound of Formula (VIII):

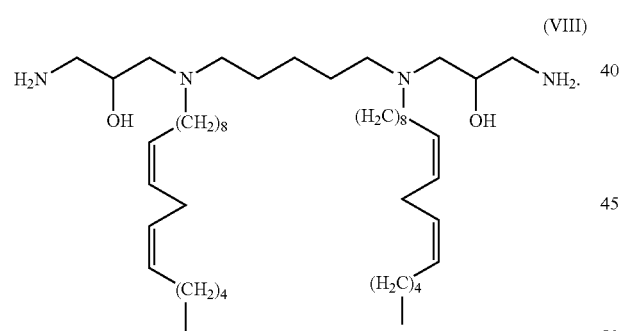
(VIII)

In embodiments, the present invention relates to a compound of Formula (IX):

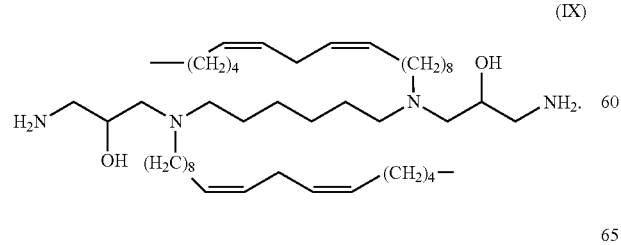
(IX)

In embodiments, the present invention relates to a compound of Formula (X):

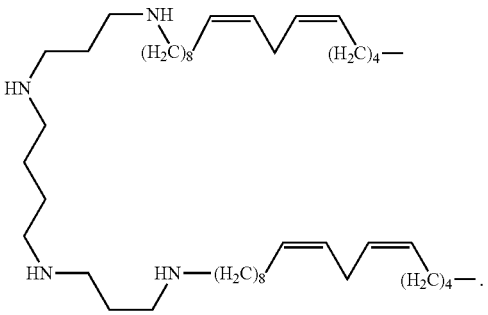
(X)

In embodiments, the present invention relates to a compound of Formula (XI):

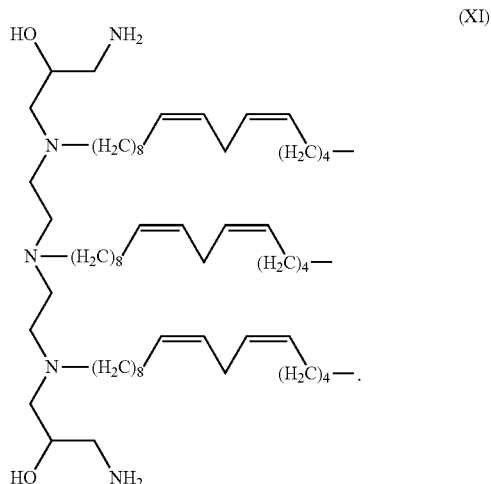
(XI)

In embodiments, the present invention relates to a compound of Formula (XII):

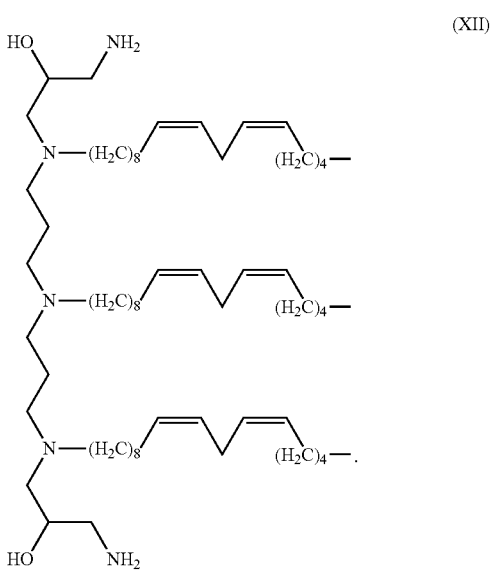
(XII)

In embodiments, the present invention relates to a compound of Formula (XIII):

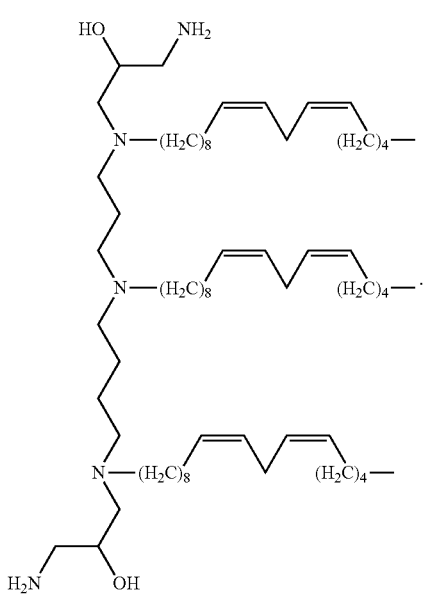

(XIII)

In embodiments, the present invention relates to a compound of Formula (XIV):

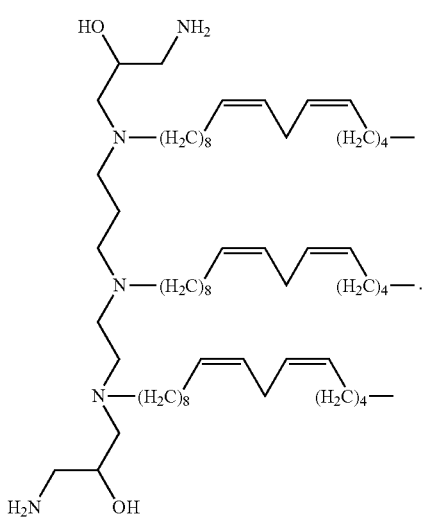

(XIV)

In embodiments, the present invention relates to a compound of Formula (XV):

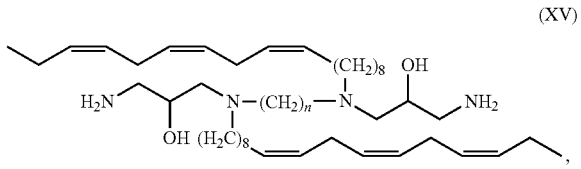

(XV)

wherein n is 1, 2, 3, 4, 5, 6, 7, 8, 9, 10, 11, 12, 13, 14, or 15.

In embodiments, the present invention relates to a compound of Formula (XVI):

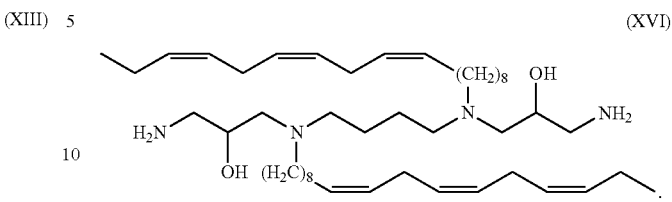

(XVI)

The present invention also relates to intermediates and synthetic methods for preparing the compound (e.g. of Formulae I-XVI) and compositions of the invention.

In embodiments, the compound (e.g. of Formulae I-XVI), and/or pharmaceutical composition and/or lipid aggregate and/or lipid carrier and/or lipid nucleic-acid complex and/or liposome and/or lipid nanoparticle comprising the compound (e.g. of Formulae I-XVI), is soluble in an alcohol (e.g. ethyl alcohol) at room temperature (e.g. about 20-25° C.) and/or at low temperatures (e.g. about 0° C., or about −10° C., or about −20° C., or about −30° C., or about −40° C., or about −50° C., or about −60° C., or about −70° C., or about −80° C.).

Certain synthetic methods, e.g. that are useful for preparation of a compound described herein (e.g. of Formulae I-XVI), have been discovered. Certain embodiments relate to a method for extracting an organic compound from a reaction containing lithium and/or aluminum compounds. Other embodiments relate to a method for extracting an organic compound from a reaction containing a reducing agent. In one embodiment, the reducing agent is a metal hydride. In another embodiment, the reducing agent is lithium aluminum hydride. In some embodiments, the reaction is quenched with water to yield a quenched reaction. In other embodiments one or more solvents are removed from the quenched reaction, e.g. by evaporation. In one embodiment, the quenched reaction is dried, e.g. with heat and/or under reduced pressure. In another embodiment, the dried, quenched reaction is extracted with a solvent. In some embodiments, the solvent is an alcohol. In one embodiment, the alcohol is isopropyl alcohol. In another embodiment the isopropyl alcohol is heated to about 80° C. In a further embodiment, the solvent containing the organic compound is decanted and/or filtered. In a still further embodiment, the solvent is removed, e.g. by evaporation, to yield the organic compound.

Methods for purifying the compounds of the present invention (e.g. of Formulae I-XVI) have also been discovered. Certain embodiments are therefore directed to a method for purifying a compound (e.g. of Formulae I-XVI). In one embodiment, a sample containing a compound (e.g. of Formulae I-XVI) and one or more impurities is suspended in a solvent. In one embodiment, the solvent is acetone. In another embodiment, the solvent is heated. In some embodiments, the compound is soluble in the solvent. In other embodiments at least one of the one or more impurities is insoluble in the solvent. In one embodiment, the one or more impurities comprise a phthalimide derivative. In one embodiment, the one or more impurities comprise phthalhydrazide. In a further embodiment, the sample is suspended in acetone, the compound dissolves, and at least one of the one or more impurities forms a precipitate. In a still further embodiment, the precipitate is removed by decanting, filtration, and/or centrifugation.

In yet another embodiment, the solvent is removed, e.g. by evaporation, to yield a purified compound.

In aspects, the present invention relates to a method for extracting an organic compound from a reaction containing lithium aluminum hydride and a solvent comprising: (a) quenching the reaction with water; (b) removing the solvent; (c) removing excess water; and (d) extracting the organic compound with an alcohol (optionally isopropyl alcohol); to yield an extracted organic compound.

In aspects, the present invention relates to a method for extracting an organic compound from a reaction containing a water-reactive compound and a first solvent comprising: (a) quenching the reaction with water; (b) removing the first solvent; (c) removing excess water; and (d) extracting the organic compound with a second solvent; to yield an extracted organic compound.

In aspects, the present invention relates to a method for purifying an organic compound from a mixture of the organic compound and a phthalimide or phthalimide derivative (optionally phthalhydrazide) comprising: (a) dissolving the mixture in acetone to form a precipitate; (b) removing the precipitate by centrifugation; and (c) removing the acetone; to yield a purified organic compound.

Pharmaceutical Compositions, Lipid Aggregates, Lipid Carriers

In embodiments, the present invention relates to a pharmaceutical composition and/or a lipid aggregate and/or a lipid carrier and/or a lipid nucleic-acid complex and/or a liposome and/or a lipid nanoparticle which comprises a compound described herein (e.g. of Formulae I-XVI).

In embodiments, the pharmaceutical composition and/or lipid aggregate and/or lipid carrier and/or lipid nucleic-acid complex and/or liposome and/or lipid nanoparticle is in any physical form including, e.g., lipid nanoparticles, liposomes, micelles, interleaved bilayers, etc.

In embodiments, the pharmaceutical composition and/or a lipid aggregate and/or a lipid carrier is a liposome. In embodiments, the liposome is a large unilamellar vesicles (LUV), multilamellar vesicles (MLV) or small unilamellar vesicle (SUV). In embodiments, the liposome has a diameter up to about 50 to 80 nm. In embodiments, the liposome has a diameter of greater than about 80 to 1000 nm, or larger. In embodiments, the liposome has a diameter of about 50 to 1000 nm, e.g. about 200 nm or less. Size indicates the size (diameter) of the particles formed. Size may alternatively indicate the hydrodynamic radius of the particles formed. Size distribution may be determined using quasi-elastic light scattering (QELS) on a Nicomp Model 370 sub-micron particle sizer.

In certain embodiments, the present invention relates to methods and compositions for producing lipid-encapsulated nucleic acid particles in which nucleic acids are encapsulated within a lipid layer. Such nucleic acid-lipid particles, including, without limitation incorporating RNAs, are characterized using a variety of biophysical parameters including: drug to lipid ratio; encapsulation efficiency; particle size, and polydispersity index (PDI). High drug to lipid ratios, high encapsulation efficiency, good nuclease resistance and serum stability and controllable particle size, generally less than 200 nm in diameter are desirable (without limitation).

In certain embodiments, a particle size, which can affect transfection efficiency, depends on an ionic strength of a complexation medium. In other embodiments, particle size may depend on the ionic strength of a body fluid. In embodiments, the particle size depends on the pH of a complexation medium, or on the pH of a body fluid. In various embodiments, the particle size depends on the complexation time or temperature, or on the rate of mixing of components of a pharmaceutical composition and/or a lipid aggregate and/or a lipid carrier and/or a lipid nucleic-acid complex and/or a liposome and/or a lipid nanoparticle. In some embodiments, the particle size can be measured as a Z-average particle size, which reports the average size of a particle distribution. In some embodiments, a desirable size of the particles is from about 100 nm to about 200 nm, or from about 150 nm to about 200 nm, or from about 150 nm to about 175 nm, or from about 155 to about 165 nm.

Another physical attribute of the lipid nanoparticles in accordance with the present invention is a polydispersity index (PDI), which is an indication of their size distribution. The term "polydispersity" (or "dispersity") is used to describe the degree of non-uniformity of a size distribution of particles. The PDI is dimensionless and it is scaled such that values smaller than 0.15 are considered monodisperse. Danaei et al., *Pharmaceutics*. 2018 May 18; 10(2):57. PDI values larger than 0.7 indicate that the sample has a very broad particle size distribution and may be suitable to be analyzed by the dynamic light scattering (DLS) technique. Id. PDI values of below 0.3 are deemed acceptable in drug delivery applications using lipid-based carriers, and the values below 0.2 are commonly deemed acceptable in practice for various polymer-based nanoparticles. Id.; see also Badran et al., *Digest J. Nanomater*. Biostruct. 2014, 9, 83-91; Chen et al., *Int. J. Pharm*. 2011, 408, 223-234; Putri et al., *J. Pharm. Sci*. Commun. 2017, 14, 79-85.

In some embodiments, a measure of a particle size (e.g., measured as a Z-average particle size (nm)) and a measure of a PDI represent suitability of the lipid nanoparticles for transfection. In embodiments, lipid carriers in accordance with the present invention have a size of less than 200 nm in diameter and a PDI of less than 0.2.

In some embodiments, lipid carriers in accordance with the present invention have a pH-dependent zeta potential. Zeta potential, measured in volts (V) or millivolts (mV), is determined for characterization of nanoparticles to estimate the surface charge, which can be used for understanding the physical stability of nanosuspensions. Zeta potential is a key indicator of the stability of colloidal dispersions. The zeta potential is the electric potential at the boundary of the double layer (DL) or the shear plane of a particle and has values that typically range from +100 to −100 mV. Values of zeta potential that are less than negative 20 mV or greater than positive 20 mV are typically desired for an electrostatically stabilized suspension. Zeta potential is affected by a pH of the medium. Other factors include ionic strength, concentration of additive(s), and temperature.

In some embodiments, a Zeta potential of a pharmaceutical composition comprising lipid particles is less than −20 mV at a pH of greater than 7.0, or less than −20 mV at a pH of greater than 7.1, or less than −20 mV at a pH of greater than 7.2, or less than −20 mV at a pH of greater than 7.3, or less than −20 mV at a pH of greater than 7.4, or less than −20 mV at a pH of greater than 7.5.

In embodiments, the compound, pharmaceutical composition, or lipid aggregate in accordance with the present disclosure has the Z-average particle size from about 50 nm to about 2000 nm, or from about 700 nm to about 1500 nm. In some embodiments, the Z-average particle size is about 750 nm. In some embodiments, the Z-average particle size is less than about 200 nm. In some embodiments, titrable particle size is desired, without limitation, to determine the ability of the compound, or pharmaceutical composition, or lipid aggregate, to permeate in vivo from the site of administration.

In some embodiments, properties of a medium in which a compound, pharmaceutical composition, or lipid aggregate in accordance with the present disclosure is formed are used to control the Z-average particle size.

In embodiments, the ionic strength of a medium in which a compound, pharmaceutical composition, or lipid aggregate in accordance with the present disclosure is formed is used to control the Z-average particle size.

In embodiments, the particle size is determined by control of the concentration of any one or more solutes (e.g., without limitation, sodium chloride, or calcium chloride, or potassium chloride, or sodium phosphate) in the medium of formation of the lipid aggregate. In embodiments, the lipid aggregate is formed in deionized water, with no solutes added, which may optionally be used to control the particle size.

In embodiments, the ionic strength of a medium in which a compound, pharmaceutical composition, or lipid aggregate in accordance with the present disclosure is formed, is used to maintain a particle size less than or equal to 200 nm.

In embodiments, a pH of a medium in which a compound, pharmaceutical composition, or lipid aggregate in accordance with the present disclosure is formed is used to control the Z-average particle size.

In embodiments, the compound, pharmaceutical composition, or lipid aggregate in accordance with the present disclosure comprises a stable dispersion of particles. In some embodiments, the stable dispersion has a pH from about 7.0 to about 8.0, or a pH of about 7.4.

In some embodiments, complexation of a nucleic acid (e.g., a small interfering RNA (siRNA), micro RNA (miRNA), messenger RNA (mRNA), long non-coding RNA (lncRNA), plasmid DNA, etc.) with a lipid nanoparticle confers nuclease resistance. In some embodiments, the nuclease is an RNase, optionally RNase A. In some embodiments, the RNase is naturally occurring in vivo.

Nucleic acid to lipid ratio is the amount of nucleic acid in a defined volume of preparation divided by the amount of lipid in the same volume. This may be on a mole per mole basis, or on a weight per weight basis, or on a weight per mole basis, or on a mole per weight basis. For final, administration-ready formulations, the nucleic acid:lipid ratio may optionally be calculated after dialysis, chromatography and/or enzyme (e.g., nuclease) digestion has been employed to remove as much external nucleic acid as possible.

Encapsulation efficiency refers to the drug (including nucleic acid) to lipid ratio of the starting mixture divided by the drug (including nucleic acid) to lipid ratio of the final, administration competent formulation. This is a measure of relative efficiency. For a measure of absolute efficiency, the total amount of nucleic acid added to the starting mixture that ends up in the administration competent formulation, can also be calculated. The amount of lipid lost during the formulation process may also be calculated. Efficiency is a measure of the wastage and expense of the formulation.

Transfection

In embodiments, the present compounds (e.g. of Formulae I-XVI) and/or pharmaceutical compositions and/or lipid aggregates and/or lipid carriers have utility in lipid aggregates for delivery of macromolecules and other compounds into cells. In embodiments, the present compounds (e.g. of Formulae I-XVI) and/or pharmaceutical compositions and/ or lipid aggregates and/or lipid carriers have utility for delivery of nucleic acids into cells.

In embodiments, there is provided a method for transfecting a cell with a nucleic acid, comprising contacting the cell with a complex of the nucleic acid and a present compound (e.g. of Formulae I-XVI) and/or pharmaceutical composition and/or lipid aggregate and/or lipid carrier. In embodiments, the complex of the nucleic acid and the present compound (e.g. of Formulae I-XVI) and/or pharmaceutical composition and/or lipid aggregate and/or lipid carrier is formed prior to contact with the cell.

In embodiments, the present compounds (e.g. of Formulae I-XVI) and/or pharmaceutical compositions and/or lipid aggregates and/or lipid carriers encapsulate nucleic acids with high-efficiency, and/or have high drug:lipid ratios, and/or protect the encapsulated nucleic acid from degradation and/or clearance in serum, and/or are suitable for systemic delivery, and/or provide intracellular delivery of the encapsulated nucleic acid. In addition, the present compounds (e.g. of Formulae I-XVI) and/or pharmaceutical compositions and/or lipid aggregates and/or lipid carriers are well-tolerated and provide an adequate therapeutic index, such that patient treatment at an effective dose of the nucleic acid is not associated with significant toxicity and/or risk to the patient.

In embodiments, the present compounds (e.g. of Formulae I-XVI) and/or pharmaceutical compositions and/or lipid aggregates and/or lipid carriers are polycationic. In embodiments, the present compounds (e.g. of Formulae I-XVI) and/or pharmaceutical compositions and/or lipid aggregates and/or lipid carriers form stable complexes with various anionic macromolecules, such as polyanions, such as nucleic acids, such as RNA or DNA. These compounds (e.g. of Formulae I-XVI) and/or pharmaceutical compositions and/ or lipid aggregates and/or lipid carriers, in various embodiments, have the property, when dispersed in water, of forming lipid aggregates which strongly, via their cationic portion, with polyanions. By using an excess of cationic charges relative to the anionic compound, the polyanion-lipid complexes may be adsorbed on cell membranes, thereby facilitating uptake of the desired compound by the cells.

In embodiments, the present compounds (e.g. of Formulae I-XVI) and/or pharmaceutical compositions and/or lipid aggregates and/or lipid carriers and/or lipid nucleic-acid complexes and/or liposomes and/or lipid nanoparticles mediate one or more of (i) compacting a nucleic acid payload to be delivered, without wishing to be bound by theory, protecting it from nuclease degradation and enhancing receptor-mediated uptake, (ii) improving association with negatively-charged cellular membranes, without wishing to be bound by theory, by giving the complexes a positive charge, (iii) promoting fusion with endosomal membranes, without wishing to be bound by theory, facilitating the release of complexes from endosomal compartments, and (iv) enhancing transport from the cytoplasm to the nucleus.

In embodiments, the present invention relates to the present compounds (e.g. of Formulae I-XVI) and/or pharmaceutical compositions and/or lipid aggregates and/or lipid carriers for transfection, or methods of transfection, which have a high transfection efficiency. In embodiments, the transfection efficiency is measured by assaying a percentage of cells that are transfected compared to the entire population, during a transfection protocol. In various embodiments, the transfection efficiency of the present compositions and methods is greater than about 30%, or greater than about 40%, or greater than about 50%, or greater than about 60%, or greater than about 70%, or greater than about 80%, or greater than about 90%, or greater than about 95%. In various embodiments, the transfection efficiency of the present compositions and methods is greater than the transfection efficiency of commercially available products (e.g. LIPOFECTIN, LIPOFECTAMINE, LIPOFECTAMINE 2000, LIPOFECTAMINE 3000 (Life Technologies)). In various embodiments, the transfection efficiency of the present compositions and methods is about 5-fold, or 10-fold, or 15-fold, or 20-fold, or 30-fold greater than the transfection efficiency of commercially available products (e.g. LIPOFECTIN, LIPOFECTAMINE, LIPOFECTAMINE 2000, LIPOFECTAMINE 3000 Life Technologies).

In embodiments, the present invention relates to the present compounds (e.g. of Formulae I-XVI) and/or pharmaceutical compositions and/or lipid aggregates and/or lipid carriers for transfection, or methods of transfection, which permit a high level of endosomal escape. In various embodiments, the endosomal escape of the present compositions and methods is greater than the endosomal escape of commercially available products (e.g. LIPOFECTIN, LIPOFECTAMINE, LIPOFECTAMINE 2000, LIPOFECTAMINE 3000 Life Technologies). In various embodiments, the endosomal escape of the present compositions and methods is about 5-fold, or 10-fold, or 15-fold, or 20-fold, or 30-fold greater than the endosomal escape of commercially available products (e.g. LIPOFECTIN, LIPOFECTAMINE, LIPOFECTAMINE 2000, LIPOFECTAMINE 3000 (Life Technologies)).

In embodiments, the present compounds (e.g. of Formulae I-XVI) and/or pharmaceutical compositions and/or lipid aggregates and/or lipid carriers are serum-resistant. In embodiments, the present compounds (e.g. of Formulae I-XVI) and/or pharmaceutical compositions and/or lipid aggregates and/or lipid carriers are substantially stable in serum. In embodiments, the present compounds (e.g. of Formulae I-XVI) and/or pharmaceutical compositions and/or lipid aggregates and/or lipid carriers are serum-resistant. In embodiments, the present transfection methods can function in the presence of serum and/or do not require serum inactivation and/or media changes. In embodiments, the stability in serum and/or serum-resistant is measurable via in vitro assays. Transfection efficiency in varying amounts of serum may be used to assess the ability to transfect a macromolecule (e.g., without limitation, DNA or RNA), optionally in comparison to commercially available products (e.g. LIPOFECTIN, LIPOFECTAMINE, LIPOFECTAMINE 2000, LIPOFECTAMINE 3000 (Life Technologies)).

In embodiments, the present invention relates to present compounds (e.g. of Formulae I-XVI) and/or pharmaceutical compositions and/or lipid aggregates and/or lipid carriers for transfection, or methods of transfection have low or reduced toxicity effects. In embodiments, the present invention relates present compounds (e.g. of Formulae I-XVI) and/or pharmaceutical compositions and/or lipid aggregates and/or lipid carriers for transfection, or methods of transfection have reduced toxicity effects as compared to commercially available products (e.g. LIPOFECTIN, LIPOFECTAMINE, LIPOFECTAMINE 2000, LIPOFECTAMINE 3000 Life Technologies). In various embodiments, the present compositions and methods allow for cells having greater than about 50%, or about 60%, or about 70%, or about 80%, or about 90%, or about 95% viability after transfection. In various embodiments, the present compositions and methods allow for cells having 5-fold, or 10-fold, or 15-fold, or 20-fold, or 30-fold greater viability after transfection, as compared to commercially available products (e.g. LIPOFECTIN, LIPOFECTAMINE, LIPOFECTAMINE 2000, LIPOFECTAMINE 3000 (Life Technologies)). In embodiments, toxicity effects include disruption in cell morphology and/or viability or deregulation of one or more genes.

In embodiments, the present invention relates to the present compounds (e.g. of Formulae I-XVI) and/or pharmaceutical compositions and/or lipid aggregates and/or lipid carriers for transfection, or methods of transfection, which permit a high level of protein expression from the nucleic acid (e.g. DNA or RNA) being transfected. In various embodiments, the protein expression of the present compositions and methods is greater than about 30%, or greater than about 40%, or greater than about 50%, or greater than about 60%, or greater than about 70%, or greater than about 80%, or greater than about 90%, or greater than about 95% than untransfected. In various embodiments, the resultant protein expression of the present compositions and methods is greater than the resultant protein expression of commercially available products (e.g. LIPOFECTIN, LIPOFECTAMINE, LIPOFECTAMINE 2000, LIPOFECTAMINE 3000 (Life Technologies)). In various embodiments, the resultant protein expression of the present compositions and methods is about 5-fold, or 10-fold, or 15-fold, or 20-fold, or 30-fold greater than the resultant protein expression of commercially available products (e.g. LIPOFECTIN, LIPOFECTAMINE, LIPOFECTAMINE 2000, LIPOFECTAMINE 3000 (Life Technologies)).

In embodiments, the present invention relates to the present compounds (e.g. of Formulae I-XVI) and/or pharmaceutical compositions and/or lipid aggregates and/or lipid carriers for transfection, or methods of transfection, which allow for transfection, including efficient transfection as described herein, in various cell types.

In embodiments, the present invention relates to the present compounds (e.g. of Formulae I-XVI) and/or pharmaceutical compositions and/or lipid aggregates and/or lipid carriers for transfection, or methods of transfection, which allow for transfection, including efficient transfection as described herein, in established cell lines, hard-to-transfect cells, primary cells, stem cells, and blood cells. In embodiments, the cell type is a keratinocyte, fibroblast, or PBMC.

In embodiments, present compounds (e.g. of Formulae I-XVI), pharmaceutical composition and/or a lipid aggregate and/or a lipid carrier is suitable for transfection or delivery of compounds to target cells, either in vitro or in vivo.

In embodiments, the present invention relates to present compounds (e.g. of Formulae I-XVI) and/or pharmaceutical compositions and/or lipid aggregates and/or lipid carriers for transfection, or methods of transfection that do not require additional reagents for transfection, e.g. the LipofectAMINE PLUS Reagent (Life Technologies).

In embodiments, the present compounds are components of a pharmaceutical composition and/or a lipid aggregate and/or a lipid carrier which does not require an additional or helper lipid, e.g. for efficient transfection. For instance, in embodiments, the pharmaceutical composition and/or a lipid aggregate and/or a lipid carrier which does not require one or more of DOPE, DOPC, cholesterol, and a polyethylene glycol (PEG)-modified lipid (inclusive, without limitation, or a PEGylation of DOPE, DOPC, and/or cholesterol), e.g. for efficient transfection.

In embodiments, the present compounds are components of a pharmaceutical composition and/or a lipid aggregate and/or a lipid carrier that further comprise an additional or helper lipid.

In embodiments, the additional or helper lipid is selected from one or more of the following categories: cationic lipids; anionic lipids; neutral lipids; multi-valent charged lipids; and zwitterionic lipids. In some cases, a cationic lipid may be used to facilitate a charge-charge interaction with nucleic acids.

In embodiments, the additional or helper lipid is a neutral lipid. In embodiments, the neutral lipid is dioleoylphosphatidylethanolamine (DOPE), 1,2-Dioleoyl-sn-glycero-3-phosphocholine (DOPC), or cholesterol. In embodiments, cholesterol is derived from plant sources. In other embodiments, cholesterol is derived from animal, fungal, bacterial or archaeal sources.

In embodiments, the additional or helper lipid is a further cationic lipid. In embodiments, the cationic lipid is N-[1-(2,3-dioleoyloxy)propyl]-N,N,N-trimethylammonium chloride (DOTMA), 1,2-bis(oleoyloxy)-3-3-(trimethylammonia) propane (DOTAP), or 1,2-dioleoyl-3-dimethylammonium-propane (DODAP).

In embodiments, the phospholipids 18:0 PC, 18:1 PC, 18:2 PC, 18:2 PE, DSPE, DOPE, 18:2 PE, DMPE or a combination thereof are used as helper lipids. In embodiments, the additional or helper lipid is DOTMA and DOPE, optionally in a ratio of about 1:1. In embodiments, the additional or helper lipid is DHDOS and DOPE, optionally in a ratio of about 1:1.

In embodiments, the additional or helper lipid is a commercially available product (e.g. LIPOFECTIN, LIPOFECTAMINE, LIPOFECTAMINE 2000, LIPOFECTAMINE 3000 Life Technologies).

In embodiments, the additional or helper lipid is a compound having the Formula (A):

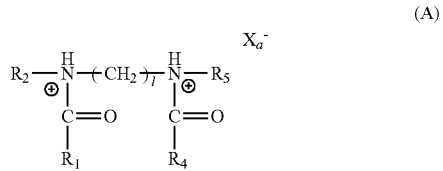

(A)

Where, $R_1$ and $R_4$ are straight-chain alkenyl having 17 carbon atoms; $R_2$ and $R_5$ are —(CH2)p-NH2 where p is 1-4; l is 1-10; and Xa is a physiologically acceptable anion.

In embodiments, the additional or helper lipid is a PEGylated lipid. In embodiments, the PEGylated lipid has a PEG molecule covalently attached to it, where the PEG has an average molecular weight of from about 10 kDa to about 400 kDa. In embodiments, the polyethylene glycols, which are suitable for use in the present invention are those having an average molecular weight of at least 10,000 daltons to 40,000 daltons. In embodiments, the PEGs have an average molecular weight of 20,000 daltons, such as an average molecular weight of in the range of 20,000 to 700,000 daltons, for example in the range of 20,000 to 600,000 daltons, such as in the range of 35,000 to 500,000 daltons, for example in the range of 35,000 to 400,000 daltons, such as in the range of 35,000 to 350,000 daltons, for example in the range of 50,000 to 350,000 daltons, such as in the range of 100,000 to 300,000 daltons, for example in the range of 150,000 to 350,000 daltons, such as in the range of 200,000 to 300,000 daltons. In certain embodiments, polyethylene glycols suitable for use with the compositions and methods described herein are those having an average molecular weight selected from approximately 10,000 daltons, approximately 15,000 daltons, approximately 20,000 daltons, approximately 25,000 daltons, approximately 30,000 daltons, approximately 35,000 daltons, approximately 50,000 daltons, approximately 75,000 daltons, approximately 100,000 daltons, approximately 150,000 daltons, approximately 200,000 daltons, approximately 250,000 daltons, approximately 300,000 daltons, approximately 400,000 daltons, 150,000 daltons, 200,000 daltons, 250,000 daltons, 300,000 daltons, 400,000 daltons. In the present context, referring to the average molecular weight of polyethylene glycols, "approximately" means+/−30%. In embodiments, PEG, that is attached covalently to the with the compositions and methods described herein, has an average molecular weight of 10 kDa, 20 kDa, or 40 kDa. In embodiments, the PEG, is a branched PEG, a star PEG, or a comb PEG.

In one embodiment, the present compounds (e.g. of Formulae I-XVI) and/or pharmaceutical compositions and/or lipid aggregates and/or lipid carriers include one or more polyethylene glycol (PEG) chains, optionally selected from PEG200, PEG300, PEG400, PEG600, PEG800, PEG1000, PEG1500, PEG2000, PEG3000, and PEG4000.

In embodiments, the PEG is PEG2000. In embodiments, the present compounds (e.g. of Formulae I-XVI) and/or pharmaceutical compositions and/or lipid aggregates and/or lipid carriers include 1,2-distearoyl-sn-glycero-3-phosphoethanolamine (DSPE) or a derivative thereof. In one embodiment, the present compounds (e.g. of Formulae I-XVI) and/or pharmaceutical compositions and/or lipid aggregates and/or lipid carriers comprise PEGylated lipid 1,2-distearoyl-sn-glycero-3-phosphoethanolamine-N-[methoxy(polyethylene glycol)-2000] (DSPE-PEG); in another embodiment, the present compounds (e.g. of Formulae I-XVI) and/or pharmaceutical compositions and/or lipid aggregates and/or lipid carriers comprise 1,2-dimyristoyl-sn-glycero-3-phosphoethanolamine-N-[methoxy(polyethylene glycol)-2000] (DMPE-PEG); in yet another embodiment, the present compounds (e.g. of Formulae I-XVI) and/or pharmaceutical compositions and/or lipid aggregates and/or lipid carriers comprise 1,2-dimyristoyl-rac-glycero-3-methoxypolyethylene glycol-2000 (DMG-PEG). In further embodiments, the present compounds (e.g. of Formulae I-XVI) and/or pharmaceutical compositions and/or lipid aggregates and/or lipid carriers comprise a mixture of PEGylated lipids or free PEG chains.

In embodiments, the present compounds (e.g. of Formulae I-XVI) and/or pharmaceutical compositions and/or lipid aggregates and/or lipid carriers comprise one or more of N-(carbonyl-ethoxypolyethylene glycol 2000)-1,2-distearoyl-sn-glycero-3-phosphoethanolamine (MPEG2000-DSPE), fully hydrogenated phosphatidylcholine, cholesterol, LIPOFECTAMINE 3000, a cationic lipid, a polycationic lipid, and 1,2-distearoyl-sn-glycero-3-phosphoethanolamine-N-[folate(polyethylene glycol)-5000] (FA-MPEG5000-DSPE).

In some embodiments, one or more PEGylated helper lipids are incorporated into pharmaceutical compositions and/or lipid aggregates and/or lipid carriers and/or liposomes and/or lipid nanoparticles comprising the present compounds (e.g. of Formulae I-XVI). In some embodiments, the concentration of PEGylated helper lipid, or the ratio of PEGylated helper lipid to any one or more of the present compounds (e.g., of Formulae I-XVI), or the ratio of PEGylated helper lipid to nucleic acid is used to affect particle size. In some embodiments, particle size is determined by other factors (e.g., without limitation, ionic strength of the solution containing the particles, addition of salts to a solution containing the particles, addition of other small molecules to a solution containing the particles, adjustment of the pH of a solution containing the particles). In some embodiments, particle size control by other factors is used in conjunction with one or more PEGylated helper lipids, or in place of one or more PEGylated helper lipids.

In one embodiment, the present compounds (e.g. of Formulae I-XVI) and/or pharmaceutical compositions and/or lipid aggregates and/or lipid carriers comprise about 3.2 mg/mL N-(carbonyl-ethoxypolyethylene glycol 2000)-1,2-distearoyl-sn-glycero-3-phosphoethanolamine (MPEG2000-DSPE), about 9.6 mg/mL fully hydrogenated phosphatidylcholine, about 3.2 mg/mL cholesterol, about 2 mg/mL ammonium sulfate, and histidine as a buffer, with about 0.27 mg/mL 1,2-distearoyl-sn-glycero-3-phosphoethanolamine-N-[folate(polyethylene glycol)-5000] (FA-MPEG5000-DSPE) added to the lipid mixture. In another embodiment, the nucleic acids are complexed by combining 1 μL of LIPOFECTAMINE 3000 per about 1 μg of nucleic acid and incubating at room temperature for at least about 5 minutes. In one embodiment, the LIPOFECTAMINE 3000 is a solution comprising a lipid at a concentration of about 1 mg/mL. In embodiments, nucleic acids are encapsulated by combining about 10 μg of the present compounds (e.g. of Formulae I-XVI) and/or pharmaceutical compositions and/or lipid aggregates and/or lipid carriers per about 1 μg of nucleic acid and incubating at room temperature for about 5 minutes.

In embodiments, the present compounds (e.g. of Formulae I-XVI) and/or pharmaceutical compositions and/or lipid aggregates and/or lipid carriers comprise one or more nanoparticles. In one embodiment, the nanoparticle is a polymeric nanoparticle. In various embodiments, the present compounds (e.g. of Formulae I-XVI) and/or pharmaceutical compositions and/or lipid aggregates and/or lipid carriers comprise one or more of a diblock copolymer, a triblock copolymer, a tetrablock copolymer, and a multiblock copolymer. In various embodiments, the present compounds (e.g. of Formulae I-XVI) and/or pharmaceutical compositions and/or lipid aggregates and/or lipid carriers comprise one or more of polymeric nanoparticles comprising a polyethylene glycol (PEG)-modified polylactic acid (PLA) diblock copolymer (PLA-PEG), PEG-polypropylene glycol-PEG-modified PLA-tetrablock copolymer (PLA-PEG-PPG-PEG), and Poly(lactic-co-glycolic acid) copolymer. In another embodiment, the present compounds (e.g. of Formulae I-XVI) and/or pharmaceutical compositions and/or lipid aggregates and/or lipid carriers comprise a statistical, or an alternating, or a periodic copolymer, or any other sort of polymer.

In embodiments, the present compounds (e.g. of Formulae I-XVI) and/or pharmaceutical compositions and/or lipid aggregates and/or lipid carriers comprise one or more lipids that are described in WO/2000/027795, the entire contents of which are hereby incorporated by reference.

In embodiments, the present compounds (e.g. of Formulae I-XVI) and/or pharmaceutical compositions and/or lipid aggregates and/or lipid carriers comprises Polybrene™ (hexadimethrine bromide) as described in U.S. Pat. No. 5,627,159, the entire contents of which is incorporated herein by reference.

In various embodiments, the present compounds (e.g. of Formulae I-XVI) and/or pharmaceutical compositions and/or lipid aggregates and/or lipid carriers comprise one or more polymers. Examples of polymer include hexadimethrine bromide (Polybrene™), DEAE-Dextran, protamine, protamine sulfate, poly-L-lysine, or poly-D-lysine. These polymers may be used in combination with cationic lipids to result in synergistic effects on uptake by cells, stability of the present compounds (e.g. of Formulae I-XVI) and/or pharmaceutical compositions and/or lipid aggregates and/or lipid carriers, including serum stability (e.g., stability in vivo), endosomal escape, cell viability, and protein expression.

In embodiments, the present compounds are components of a pharmaceutical composition and/or a lipid aggregate and/or a lipid carrier that further comprise one or more additional lipids or polymers selected from Table 1. In other embodiments, the nucleic acids of the present invention are components of a pharmaceutical composition and/or a lipid aggregate and/or a lipid carrier that further comprise one or more lipids or polymers selected from Table 1.

In various embodiments, one or more, or two or more, or three or more, or four or more, or five or more of the lipids of Table 1 are combined in a formulation with the present compounds and are components of a pharmaceutical composition and/or a lipid aggregate and/or a lipid carrier.

TABLE 1

Illustrative Biocompatible Lipids and Polymers

3β-[N-(N',N'-dimethylaminoethane)-carbamoyl]cholesterol (DC-Cholesterol)
1,2-dioleoyl-3-trimethylammonium-propane (DOTAP/18:1 TAP)
N-(4-carboxybenzyl)-N,N-dimethyl-2,3-bis(oleoyloxy)propan-1-aminium (DOBAQ)
1,2-dimyristoyl-3-trimethylammonium-propane (14:0 TAP)
1,2-dipalmitoyl-3-trimethylammonium-propane (16:0 TAP)
1,2-stearoyl-3-trimethylammonium-propane (18:0 TAP)
1,2-dioleoyl-3-dimethylammonium-propane (DODAP/18:1 DAP)
1,2-dimyristoyl-3-dimethylammonium-propane (14:0 DAP)
1,2-dipalmitoyl-3-dimethylammonium-propane (16:0 DAP)
1,2-distearoyl-3-dimethylammonium-propane (18:0 DAP)
dimethyldioctadecylammonium (18:0 DDAB)
1,2-dilauroyl-sn-glycero-3-ethylphosphocholine (12:0 EthylPC)
1,2-dimyristoyl-sn-glycero-3-ethylphosphocholine (14:0 EthylPC)
1,2-dimyristoleoyl-sn-glycero-3-ethylphosphocholine (14:1 EthylPC)
1,2-dipalmitoyl-sn-glycero-3-ethylphosphocholine (16:0 EthylPC)
1,2-distearoyl-sn-glycero-3-ethylphosphocholine (18:0 EthylPC)
1,2-dioleoyl-sn-glycero-3-ethylphosphocholine (18:1 EthylPC)
1-palmitoyl-2-oleoyl-sn-glycero-3-ethylphosphocholine (16:1-18:1 EthylPC)
1,2-di-O-octadecenyl-3-trimethylammonium propane (DOTMA)
N1-[2-((1S)-1-[(3-aminopropyl)amino]-4-[di(3-amino-propyl)amino] butylcarboxamido)ethyl]-3,4-di[oleyloxy]-benzamide (MVL5)
2,3-dioleyloxy-N-[2-spermine carboxamide]ethyl-N,N-dimethyl-1-propanammonium trifluoroacetate (DOSPA)
1,3-di-oleoyloxy-2-(6-carboxy-spermyl)-propylamid (DOSPER)
N-[1-(2,3-dimyristyloxy)propyl]-N,N-dimethyl-N-(2-hydroxyethyl) ammonium bromide (DMRIE)
LIPOFECTAMINE, LIPOFECTAMINE 2000, LIPOFECTAMINE RNAiMAX, LIPOFECTAMINE 3000, LIPOFECTAMINE MessengerMAX, TransIT mRNA
dioctadecyl amidoglyceryl spermine (DOGS)
dioleoyl phosphatidyl ethanolamine (DOPE)
1,2-dilinoleyloxy-3-dimethylaminopropane (DLinDMA)
1,2-dilinoleyl-4-(2-dimethylaminoethyl)-[1,3]-dioxolane (DLin-KC2-DMA)
Heptatriaconta-6,9,28,31-tetraen-19-yl 4-(dimethylamino)butanoate (DLin-MC3-DMA)
N1,N4-dimyristyl-N1,N4-di-(2-hydroxy-3-aminopropyl)-diaminobutane (DHDMS)
N1,N4-dioleyl-N1,N4-di-(2-hydroxy-3-aminopropyl)-diaminobutane (DHDOS)
1,2-distearoyl-sn-glycero-3-phosphocholine (18:0 PC DSPC)
1,2-dioleyl-sn-glycero-3-phosphocholine (18:1 PC)
1,2-distearyl-sn-glycero-3-phosphatidyl ethanolamine (DSPE)
1,2-dilinoleyl-3-dimethylammonium-propane (18:2 DAP)
hexadimethrine bromide (Polybrene ™)
DEAE-Dextran
protamine TABLE 1-continued Illustrative Biocompatible Lipids and Polymers protamine sulfate
poly-L-lysine
poly-D-lysine
Poly(beta-amino-ester) polymer
polyethyleneimine
block co-polymer comprising one or more of: PEG, PLGA, PPG, PEI, PLL, PCL,
a PLURONIC Additional components that may be present in a pharmaceutical composition and/or a lipid aggregate and/or a lipid carrier and/or a lipid nucleic-acid complex and/or a liposome and/or a lipid nanoparticle of the present invention include bilayer stabilizing components such as polyamide oligomers (see, e.g., U.S. Pat. No. 6,320,017), peptides, proteins, detergents, lipid-derivatives, such as PEG coupled to phosphatidylethanolamine and PEG conjugated to ceramides (see, U.S. Pat. No. 5,885,613).

In embodiments, the present lipids include a further cationic lipid, a neutral lipid, a sterol, and a lipid selected to reduce aggregation of lipid particles during formation, which may result from steric stabilization of particles which prevents charge-induced aggregation during formation. Examples of lipids that reduce aggregation of particles during formation include polyethylene glycol (PEG)-modified lipids, monosialoganglioside Gm1, and polyamide oligomers ("PAO") such as (described in U.S. Pat. No. 6,320,017). Other compounds with uncharged, hydrophilic, steric-barrier moieties, which prevent aggregation during formulation, like PEG, Gm1 or ATTA, can also be coupled to lipids for use as in the methods and compositions of the invention. ATTA-lipids are described, e.g., in U.S. Pat. No. 6,320,017, and PEG-lipid conjugates are described, e.g., in U.S. Pat. Nos. 5,820,873, 5,534,499 and 5,885,613. Typically, the concentration of the lipid component selected to reduce aggregation is about 0.1 to 15% (by mole percent of lipids). If the particles are stable after formulation, the PEG or ATTA can be dialyzed away before administration to a subject.

In embodiments, it is desirable to target the present compounds (e.g. of Formulae I-XVI) and/or pharmaceutical compositions and/or lipid aggregates and/or lipid carriers using targeting moieties that are specific to a cell type or tissue. Targeting of lipid particles using a variety of targeting moieties, such as ligands, cell surface receptors, glycoproteins, vitamins (e.g., riboflavin) and monoclonal antibodies, has been previously described (see, e.g., U.S. Pat. Nos. 4,957,773 and 4,603,044). The targeting moieties can comprise the entire protein or fragments thereof.

Targeting mechanisms generally require that the targeting agents be positioned on the surface of the lipid particle in such a manner that the target moiety is available for interaction with the target, for example, a cell surface receptor. A variety of different targeting agents and methods are known and available in the art, including those described, e.g., in Sapra and Allen, *Prog. Lipid Res.* 42(5):439-62 (2003); and Abra et al., *J. Liposome Res.* 12:1-3, (2002). Standard methods for coupling the target agents can be used. For example, phosphatidylethanolamine, which can be activated for attachment of target agents, or derivatized lipophilic compounds, such as lipid-derivatized bleomycin, can be used. Antibody-targeted liposomes can be constructed using, for instance, liposomes that incorporate protein A (see, Renneisen, et al., *J. Bio. Chem.*, 265:16337-16342 (1990) and Leonetti, et al., *Proc. Natl. Acad. Sci.* (USA), 87:2448-2451 (1990). Other examples of antibody conjugation are disclosed in U.S. Pat. No. 6,027,726, the teachings of which are incorporated herein by reference. Examples of targeting moieties can also include other proteins, specific to cellular components, including antigens associated with neoplasms or tumors. Proteins used as targeting moieties can be attached to the liposomes via covalent bonds (see, Heath, Covalent Attachment of Proteins to Liposomes, 149 Methods in Enzymology 111-119 (Academic Press, Inc. 1987)). Other targeting methods include the biotin-avidin system.

In embodiments, the present compositions and methods employ a complexation medium. In an embodiment, the complexation medium has a pH greater than about 7, or greater than about 7.2, or greater than about 7.4, or greater than about 7.6, or greater than about 7.8, or greater than about 8.0, or greater than about 8.2, or greater than about 8.4, or greater than about 8.6, or greater than about 8.8, or greater than about 9.0. In an embodiment, the complexation medium comprises transferrin. In a further embodiment, the complexation medium comprises DMEM. In a still further embodiment, the complexation medium comprises DMEM/F12.

Nucleic Acids

In embodiments, the present compounds (e.g. of Formulae I-XVI) and/or pharmaceutical compositions and/or lipid aggregates and/or lipid carriers are suitable for associating with a nucleic acid, inclusive of, for instance, include any oligonucleotide or polynucleotide.

In embodiments, the nucleic acid is an RNA, a small interfering RNA (siRNA), micro RNA (miRNA), messenger RNA (mRNA), long non-coding RNA (lncRNA), antisense oligonucleotide, ribozyme, plasmid, immune stimulating nucleic acid, antisense, antagomir, antimir, microRNA mimic, supermir, U1 adaptor, or aptamer.

In embodiments, nucleic acids are fully encapsulated within the present compounds (e.g. of Formulae I-XVI) and/or pharmaceutical compositions and/or lipid aggregates and/or lipid carriers. In other embodiments, nucleic acids are partially encapsulated within the present compounds (e.g. of Formulae I-XVI) and/or pharmaceutical compositions and/or lipid aggregates and/or lipid carriers. In still other embodiments, nucleic acids and the present compounds (e.g. of Formulae I-XVI) and/or pharmaceutical compositions and/or lipid aggregates and/or lipid carriers are both present with no encapsulation of the nucleic acids within the present compounds (e.g. of Formulae I-XVI) and/or pharmaceutical compositions and/or lipid aggregates and/or lipid carriers.

Fully encapsulated indicates that the nucleic acid in the present compounds (e.g. of Formulae I-XVI) and/or pharmaceutical compositions and/or lipid aggregates and/or lipid carriers is not significantly degraded after exposure to serum or a nuclease assay that would significantly degrade free nucleic acids. In a fully encapsulated system, in embodiments, less than about 25% of particle nucleic acid is degraded in a treatment that would normally degrade about 100% of free nucleic acid. In embodiments, less than about 10% or less than about 5% of the particle nucleic acid is degraded.

Extent of encapsulation may be determined by an Oligreen assay. Oligreen is an ultra-sensitive fluorescent nucleic acid stain for quantitating oligonucleotides and single-stranded DNA in solution (available from Invitrogen Corporation, Carlsbad, CA).

Fully encapsulated also suggests that the present compounds (e.g. of Formulae I-XVI) and/or pharmaceutical compositions and/or lipid aggregates and/or lipid carriers are serum stable, that is, that they do not rapidly decompose into their component parts upon in vivo administration.

In embodiments, the present compounds (e.g. of Formulae I-XVI) and/or pharmaceutical compositions and/or lipid aggregates and/or lipid carriers are complexed with a nucleic acid (e.g. DNA or RNA) in different ratios depending on the target cell type, generally ranging from about 1:16 to about 25:1 ng lipid:ng RNA. Illustrative lipid:RNA ratios are from about 1:1 to about 10:1, e.g. without limitation, about 2.5:1, or about 5:1.

Additional parameters such as nucleic acid concentration, buffer type and concentration, etc., will have an effect on transfection efficiency, and can be altered by routine experimentation by a person of ordinary skill in the art.

In embodiments, the nucleic acid is selected from RNA or DNA.

In embodiments, the DNA is a plasmid, cosmid, phage, recombinant virus or other vector. In embodiments, a vector (or plasmid) refers to discrete elements that are used to, for example, introduce heterologous nucleic acid into cells for expression or replication thereof. The vectors can remain episomal or can be designed to effect integration of a gene or portion thereof into a chromosome of the genome. Also contemplated are vectors that are artificial chromosomes, such as yeast artificial chromosomes and mammalian artificial chromosomes. Selection and use of such vehicles are well known to those of skill in the art. Included are vectors capable of expressing DNA that is operatively linked with regulatory sequences, such as promoter regions, that are capable of effecting expression of such DNA fragments (e.g. expression vectors). Thus, a vector refers to a recombinant DNA or RNA construct, such as a plasmid, a phage, recombinant virus or other vector that, upon introduction into an appropriate host cell, results in expression of the DNA. Appropriate vectors are well known to those of skill in the art and include those that are replicable in eukaryotic cells and/or prokaryotic cells and those that remain episomal or those that integrate into the host cell genome.

In embodiments, the RNA is a synthetic RNA. In embodiments, the RNA is a chemically synthesized RNA. In embodiments, the RNA is an in vitro transcribed RNA.

In embodiments, the RNA is selected from an siRNA, a lncRNA, an antisense oligonucleotide, a microRNA, an antagomir, an aptamer, a ribozyme and a mRNA.

In embodiments, the synthetic RNA (inclusive, without limitation of mRNA) does not comprise a non-canonical nucleotide.

In embodiments, the synthetic RNA (inclusive, without limitation of mRNA) comprises one or more non-canonical nucleotides.

In embodiments, the one or more non-canonical nucleotides avoids substantial cellular toxicity. In embodiments, the one or more non-canonical nucleotides substantially avoids cell toxicity in vivo. In embodiments, the one or more non-canonical nucleotides substantially avoids an immune reaction in a human subject. For example, the immune reaction may be an immune response mediated by the innate immune system. Immune response can be monitored using markers known in the art (e.g. cytokines, interferons, TLRs). In embodiments, the effective dose obviates the need for treatment of the human subject with immune suppressants agents (e.g. B18R) used to moderate the residual toxicity.

In embodiments, the immune response is reduced by about 10%, about 20%, about 30%, about 40%, about 50%, about 60%, about 70%, about 80%, about 90%, about 95%, about 99%, about 99.9%, or greater than about 99.9% as compared to the immune response induced by a corresponding unmodified nucleic acid. In embodiments, upregulation of one or more immune response markers is reduced by about 10%, about 20%, about 30%, about 40%, about 50%, about 60%, about 70%, about 80%, about 90%, about 95%, about 99%, about 99.9%, or greater than about 99.9% as compared to the upregulation of the one or more immune response markers induced by a corresponding unmodified nucleic acid. In embodiments, the immune response marker comprises an mRNA or protein product of an interferon gene, including an interferon alpha gene, IFNB1, TLR3, RARRES3, EIF2AK2, STAT1, STAT2, IFIT1, IFIT2, IFIT3, IFIT5, OAS1, OAS2, OAS3, OASL, ISG20 or a fragment, variant, analogue, or family-member thereof. In embodiments, the immune response marker comprises an mRNA or protein product of an TNF gene, including an TNF alpha gene, TNFRSF1A; TNFRSF1B; LTBR; TNFRSF4; CD40; FAS; TNFRSF6B; CD27; TNFRSF8; TNFRSF9; TNFRSF10A; TNFRSF10B; TNFRSF10C; TNFRSF10D; TNFRSF11A; TNFRSF11B; TNFRSF12A; TNFRSF13B; TNFRSF13C; TNFRSF14; NGFR; TNFRSF17; TNFRSF18; TNFRSF19; TNFRSF21; TNFRSF25; and EDA2R or a fragment, variant, analogue, or family-member thereof. In embodiments, the immune response marker comprises an mRNA or protein product of an interleukin gene, including an IL-6 gene, IL-1; IL-2; IL-3; IL-4; IL-5; IL-6; IL-7; IL-8 or CXCL8; IL-9; IL-10; IL-11; IL-12; IL-13; IL-14; IL-15; IL-16; IL-17; IL-18; IL-19; IL-20; IL-21; IL-22; IL-23; IL-24; IL-25; IL-26; IL-27; IL-28; IL-29; IL-30; IL-31; IL-32; IL-33; IL-35; IL-36 or a fragment, variant, analogue, or family-member thereof.

In embodiments, cell death is about 10%, about 25%, about 50%, about 75%, about 85%, about 90%, about 95%, or over about 95% less than the cell death observed with a corresponding unmodified nucleic acid. Moreover, cell death may affect fewer than about 50%, about 40%, about 30%, about 20%, about 10%, about 5%, about 1%, about 0.1%, about 0.01% or fewer than about 0.01% of cells contacted with the modified nucleic acids.

Certain non-canonical nucleotides, when incorporated into RNA molecules, can reduce the toxicity of the RNA molecules, in part, without wishing to be bound by theory, by interfering with binding of proteins that detect exogenous nucleic acids, for example, protein kinase R, Rig-1 and the oligoadenylate synthetase family of proteins. Non-canonical nucleotides that have been reported to reduce the toxicity of RNA molecules when incorporated therein include pseudouridine, 5-methyluridine, 2-thiouridine, 5-methylcytidine, N6-methyladenosine, and certain combinations thereof. However, the chemical characteristics of non-canonical nucleotides that can enable them to lower the in vivo toxicity of RNA molecules have, until this point, remained unknown. Furthermore, incorporation of large amounts of most non-canonical nucleotides, for example, 5-methyluridine, 2-thiouridine, 5-methylcytidine, and N6-methyladenosine, can reduce the efficiency with which RNA molecules can be translated into protein, limiting the utility of RNA molecules containing these nucleotides in applications that require protein expression. In addition, while pseudouridine can be completely substituted for uridine in RNA molecules without reducing the efficiency with which the synthetic RNA molecules can be translated into protein, in certain situations, for example, when performing frequent, repeated transfections, synthetic RNA molecules containing only adenosine, guanosine, cytidine, and pseudouridine can exhibit excessive toxicity.

In embodiments, the non-canonical nucleotides have one or more substitutions at positions selected from the 2C, 4C, and 5C positions for a pyrimidine, or selected from the 6C, 7N and 8C positions for a purine.

In embodiments, the non-canonical nucleotides comprise one or more of 5-hydroxycytidine, 5-methylcytidine, 5-hydroxymethylcytidine, 5-carboxycytidine, 5-formylcytidine, 5-methoxycytidine, pseudouridine, 5-hydroxyuridine, 5-methyluridine, 5-hydroxymethyluridine, 5-carboxyuridine, 5-formyluridine, 5-methoxyuridine, 5-hydroxpseudouridine, 5-methylpseudouridine, 5-hydroxymethylpseudouridine, 5-carboxpseudouridine, 5-formylpseudouridine, and 5-methoxypseudouridine, optionally at an amount of at least 50%, or at least 60%, or at least 70%, or at least 80%, or at least 90%, or 100% of the non-canonical nucleotides.

In embodiments, at least about 50% of cytidine residues are non-canonical nucleotides, and which are selected from 5-hydroxycytidine, 5-methylcytidine, 5-hydroxymethylcytidine, 5-carboxycytidine, 5-formylcytidine, and 5-methoxycytidine.

In embodiments, at least about 75% or at least about 90% of cytidine residues are non-canonical nucleotides, and the non-canonical nucleotides are selected from 5-hydroxycytidine, 5-methylcytidine, 5-hydroxymethylcytidine, 5-carboxycytidine, 5-formylcytidine, and 5-methoxycytidine.

In embodiments, at least about 20% of uridine, or at least about 40%, or at least about 50%, or at least about 75%, or at about least 90% of uridine residues are non-canonical nucleotides, and the non-canonical are selected from pseudouridine, 5-hydroxyuridine, 5-methyluridine, 5-hydroxymethyluridine, 5-carboxyuridine, 5-formyluridine, 5-methoxyuridine, 5-hydroxpseudouridine, 5-methylpseudouridine, 5-hydroxymethylpseudouridine, 5-carboxpseudouridine, 5-formylpseudouridine, and 5-methoxypseudouridine.

In embodiments, at least about 40%, or at least about 50%, or at least about 75%, or at about least 90% of uridine residues are non-canonical nucleotides, and the non-canonical nucleotides are selected from pseudouridine, 5-hydroxyuridine, 5-methyluridine, 5-hydroxymethyluridine, 5-carboxyuridine, 5-formyluridine, 5-methoxyuridine, 5-hydroxpseudouridine, 5-methylpseudouridine, 5-hydroxymethylpseudouridine, 5-carboxpseudouridine, 5-formylpseudouridine, and 5-methoxypseudouridine.

In embodiments, at least about 10% of guanine residues are non-canonical nucleotides, and the non-canonical nucleotide is optionally 7-deazaguanosine.

In embodiments, the synthetic RNA comprises no more than about 50% 7-deazaguanosine in place of guanosine residues.

In embodiments, the synthetic RNA does not comprise non-canonical nucleotides in place of adenosine residues.

In embodiments, the invention pertains to, RNA molecules containing one or more non-canonical nucleotides that include one or more substitutions at the 2C and/or 4C and/or 5C positions in the case of a pyrimidine or the 6C and/or 7N and/or 8C positions in the case of a purine can be less toxic than synthetic RNA molecules containing only canonical nucleotides, due in part to the ability of substitutions at these positions to interfere with recognition of synthetic RNA molecules by proteins that detect exogenous nucleic acids, and furthermore, that substitutions at these positions can have minimal impact on the efficiency with which the synthetic RNA molecules can be translated into protein, due in part to the lack of interference of substitutions at these positions with base-pairing and base-stacking interactions.

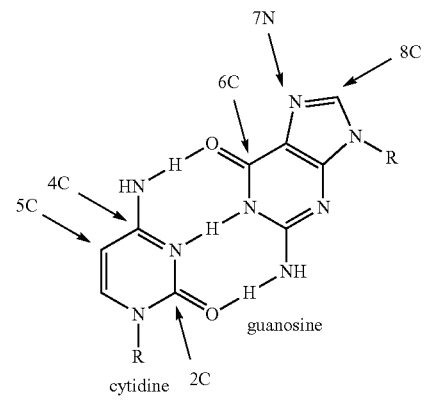

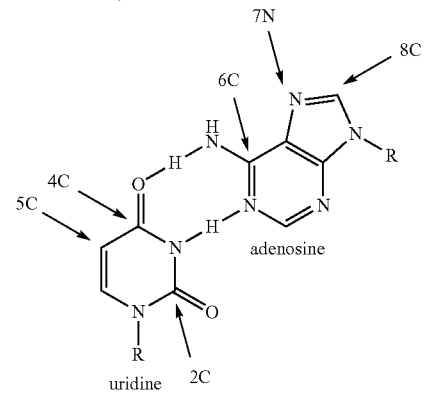

Examples of non-canonical nucleotides that include one or more substitutions at the 2C and/or 4C and/or 5C positions in the case of a pyrimidine or the 6C and/or 7N and/or 8C positions in the case of a purine include, but are not limited to 2-thiouridine, 5-azauridine, pseudouridine, 4-thiouridine, 5-methyluridine, 5-methylpseudouridine, 5-aminouridine, 5-aminopseudouridine, 5-hydroxyuridine, 5-hydroxypseudouridine, 5-methoxyuridine, 5-methoxypseudouridine, 5-hydroxymethyluridine, 5-hydroxymethylpseudouridine, 5-carboxyuridine, 5-carboxypseudouridine, 5-formyluridine, 5-formylpseudouridine, 5-methyl-5-azauridine, 5-amino-5-azauridine, 5-hydroxy-5-azauridine, 5-methylpseudouridine, 5-aminopseudouridine, 5-hydroxypseudouridine, 4-thio-5-azauridine, 4-thiopseudouridine, 4-thio-5-methyluridine, 4-thio-5-aminouridine, 4-thio-5-hydroxyuridine, 4-thio-5-methyl-5-azauridine, 4-thio-5-amino-5-azauridine, 4-thio-5-hydroxy-5-azauridine, 4-thio-5-methylpseudouridine, 4-thio-5-aminopseudouridine, 4-thio-5-hydroxypseudouridine, 2-thiocytidine, 5-azacytidine, pseudoisocytidine, N4-methylcytidine, N4-aminocytidine, N4-hydroxycytidine, 5-methylcytidine, 5-aminocytidine, 5-hydroxycytidine, 5-methoxycytidine, 5-hydroxymethylcytidine, 5-carboxycytidine, 5-formylcytidine, 5-methyl-5-azacytidine, 5-amino-5-azacytidine, 5-hydroxy-5-azacytidine, 5-methylpseudoisocytidine, 5-aminopseudoisocytidine, 5-hydroxypseudoisocytidine, N4-methyl-5-azacytidine, N4-methylpseudoisocytidine, 2-thio-5-azacytidine, 2-thiopseudoisocytidine, 2-thio-N4-methylcytidine, 2-thio-N4-aminocytidine, 2-thio-N4-hydroxycytidine, 2-thio-5-methylcytidine, 2-thio-5-aminocytidine, 2-thio-5-hydroxycytidine, 2-thio-5-methyl-5-azacytidine, 2-thio-5-amino-5-azacytidine, 2-thio-5-hydroxy-5-azacytidine, 2-thio-5-methylpseudoisocytidine, 2-thio-5-aminopseudoisocytidine, 2-thio-5-hydroxypseudoisocytidine, 2-thio-N4-methyl-5-azacytidine, 2-thio-N4-methylpseudoisocytidine, N4-methyl-5-methylcytidine, N4-methyl-5-aminocytidine, N4-methyl-5-hydroxycytidine, N4-methyl-5-methyl-5-azacytidine, N4-methyl-5-amino-azacytidine, N4-methyl-5-hydroxy-5-azacytidine, N4-methyl-5-methylpseudoisocytidine, N4-methyl-5-aminopseudoisocytidine, N4-methyl-5-hydroxpseudoisocytidine, N4-amino-5-azacytidine, N4-aminopseudoisocytidine, N4-amino-5-methylcytidine, N4-amino-5-aminocytidine, N4-amino-5-hydroxycytidine, N4-amino-5-methyl-5-azacytidine, N4-amino-5-amino-5-azacytidine, N4-amino-5-hydroxy-5-azacytidine, N4-amino-5-methylpseudoisocytidine, N4-amino-5-aminopseudoisocytidine, N4-amino-5-hydroxypseudoisocytidine, N4-hydroxy-5-azacytidine, N4-hydroxypseudoisocytidine, N4-hydroxy-5-methylcytidine, N4-hydroxy-5-aminocytidine, N4-hydroxy-5-hydroxycytidine, N4-hydroxy-5-methyl-5-azacytidine, N4-hydroxy-5-amino-5-azacytidine, N4-hydroxy-5-hydroxy-5-azacytidine, N4-hydroxy-5-methylpseudoisocytidine, N4-hydroxy-5-aminopseudoisocytidine, N4-hydroxy-5-hydroxypseudoisocytidine, 2-thio-N4-methyl-5-methylcytidine, 2-thio-N4-methyl-5-aminocytidine, 2-thio-N4-methyl-5-hydroxycytidine, 2-thio-N4-methyl-5-methyl-5-azacytidine, 2-thio-N4-methyl-5-amino-5-azacytidine, 2-thio-N4-methyl-5-hydroxy-5-azacytidine, 2-thio-N4-methyl-5-methylpseudoisocytidine, 2-thio-N4-methyl-5-aminopseudoisocytidine, 2-thio-N4-methyl-5-hydroxpseudoisocytidine, 2-thio-N4-amino-5-azacytidine, 2-thio-N4-aminopseudoisocytidine, 2-thio-N4-amino-5-methylcytidine, 2-thio-N4-amino-5-aminocytidine, 2-thio-N4-amino-5-hydroxycytidine, 2-thio-N4-amino-5-methyl-5-azacytidine, 2-thio-N4-amino-5-amino-5-azacytidine, 2-thio-N4-amino-5-hydroxy-5-azacytidine, 2-thio-N4-amino-5-methylpseudoisocytidine, 2-thio-N4-amino-5-aminopseudoisocytidine, 2-thio-N4-amino-5-hydroxypseudoisocytidine, 2-thio-N4-hydroxy-5-azacytidine, 2-thio-N4-hydroxypseudoisocytidine, 2-thio-N4-hydroxy-5-methylcytidine, N4-hydroxy-5-aminocytidine, 2-thio-N4-hydroxy-5-hydroxycytidine, 2-thio-N4-hydroxy-5-methyl-5-azacytidine, 2-thio-N4-hydroxy-5-amino-5-azacytidine, 2-thio-N4-hydroxy-5-hydroxy-5-azacytidine, 2-thio-N4-hydroxy-5-methylpseudoisocytidine, 2-thio-N4-hydroxy-5-aminopseudoisocytidine, 2-thio-N4-hydroxy-5-hydroxypseudoisocytidine, N6-methyladenosine, N6-aminoadenosine, N6-hydroxyadenosine, 7-deazaadenosine, 8-azaadenosine, N6-methyl-7-deazaadenosine, N6-methyl-8-azaadenosine, 7-deaza-8-azaadenosine, N6-methyl-7-deaza-8-azaadenosine, N6-amino-7-deazaadenosine, N6-amino-8-azaadenosine, N6-amino-7-deaza-8-azaadenosine, N6-hydroxyadenosine, N6-hydroxy-7-deazaadenosine, N6-hydroxy-8-azaadenosine, N6-hydroxy-7-deaza-8-azaadenosine, 6-thioguanosine, 7-deazaguanosine, 8-azaguanosine, 6-thio-7-deazaguanosine, 6-thio-8-azaguanosine, 7-deaza-8-azaguanosine, 6-thio-7-deaza-8-azaguanosine, and 5-methoxyuridine.

In embodiments, the invention relates to one or more non-canonical nucleotides selected from 5-hydroxycytidine, 5-methylcytidine, 5-hydroxymethylcytidine, 5-carboxycytidine, 5-formylcytidine, 5-methoxycytidine, 5-hydroxyuridine, 5-hydroxymethyluridine, 5-carboxyuridine, 5-formyluridine, 5-methoxyuridine, pseudouridine, 5-hydroxypseudouridine, 5-methylpseudouridine, 5-hydroxymethylpseudouridine, 5-carboxypseudouridine, 5-formylpseudouridine, and 5-methoxypseudouridine. In embodiments, at least 50%, or at least 55%, or at least 60%, or at least 65%, or at least 70%, or at least 75%, or at least 80%, or at least 85%, or at least 90%, or at least 95%, or 100% of the non-canonical nucleotides are one or more of 5-hydroxycytidine, 5-methylcytidine, 5-hydroxymethylcytidine, 5-carboxycytidine, 5-formylcytidine, 5-methoxycytidine, 5-hydroxyuridine, 5-methyluridine, 5-hydroxymethyluridine, 5-carboxyuridine, 5-formyluridine, 5-methoxyuridine, pseudouridine, 5-hydroxypseudouridine, 5-methylpseudouridine, 5-hydroxymethylpseudouridine, 5-carboxypseudouridine, 5-formylpseudouridine, and 5-methoxypseudouridine.

In embodiments, at least about 50%, or at least about 55%%, or at least 60%, or at least 65%, or at least 70%, or at least 75%, or at least 80%, or at least 85%, or at least 90%, or at least 95%, or 100% of cytidine residues are non-canonical nucleotides selected from 5-hydroxycytidine, 5-methylcytidine, 5-hydroxymethylcytidine, 5-carboxycytidine, 5-formylcytidine, 5-methoxycytidine.

In embodiments, at least about 20%, or about 30%, or about 40%, or about 50%, or at least about 55%, or at least 60%, or at least 65%, or at least 70%, or at least 75%, or at least 80%, or at least 85%, or at least 90%, or at least 95%, or 100% of uridine residues are non-canonical nucleotides selected from 5-hydroxyuridine, 5-methyluridine, 5-hydroxymethyluridine, 5-carboxyuridine, 5-formyluridine, 5-methoxyuridine, pseudouridine, 5-hydroxypseudouridine, 5-methylpseudouridine, 5-hydroxymethylpseudouridine, 5-carboxypseudouridine, 5-formylpseudouridine, and 5-methoxypseudouridine.

In embodiments, at least about 10% (e.g. 10%, or about 20%, or about 30%, or about 40%, or about 50%) of guanosine residues are non-canonical nucleotides, and the non-canonical nucleotide is optionally 7-deazaguanosine. In embodiments, the RNA contains no more than about 50% 7-deazaguanosine in place of guanosine residues.

In embodiments, the RNA does not contain non-canonical nucleotides in place of adenosine residues.

Note that alternative naming schemes exist for certain non-canonical nucleotides. For example, in certain situations, 5-methylpseudouridine can be referred to as "3-methylpseudouridine" or "N3-methylpseudouridine" or "1-methylpseudouridine" or "N1-methylpseudouridine".

Nucleotides that contain the prefix "amino" can refer to any nucleotide that contains a nitrogen atom bound to the atom at the stated position of the nucleotide, for example, 5-aminocytidine can refer to 5-aminocytidine, 5-methylaminocytidine, and 5-nitrocytidine. Similarly, nucleotides that contain the prefix "methyl" can refer to any nucleotide that contains a carbon atom bound to the atom at the stated position of the nucleotide, for example, 5-methylcytidine can refer to 5-methylcytidine, 5-ethylcytidine, and 5-hydroxymethylcytidine, nucleotides that contain the prefix "thio" can refer to any nucleotide that contains a sulfur atom bound to the atom at the given position of the nucleotide, and nucleotides that contain the prefix "hydroxy" can refer to any nucleotide that contains an oxygen atom bound to the atom at the given position of the nucleotide, for example, 5-hydroxyuridine can refer to 5-hydroxyuridine and uridine with a methyl group bound to an oxygen atom, where the oxygen atom is bound to the atom at the 5C position of the uridine.

Certain embodiments are therefore directed to RNA comprising one or more non-canonical nucleotides, where the RNA molecule contains one or more nucleotides that includes one or more substitutions at the 2C and/or 4C and/or 5C positions in the case of a pyrimidine or the 6C and/or 7N and/or 8C positions in the case of a purine. In embodiments, the non-canonical nucleotides include at least one of pseudouridine, 2-thiouridine, 4-thiouridine, 5-azauridine, 5-hydroxyuridine, 5-methyluridine, 5-aminouridine, 2-thiopseudouridine, 4-thiopseudouridine, 5-hydroxypseudouridine, 5-methylpseudouridine, 5-aminopseudouridine, pseudoisocytidine, N4-methylcytidine, 2-thiocytidine, 5-azacytidine, 5-hydroxycytidine, 5-aminocytidine, 5-methylcytidine, N4-methylpseudoisocytidine, 2-thiopseudoisocytidine, 5-hydroxypseudoisocytidine, 5-aminopseudoisocytidine, 5-methylpseudoisocytidine, 7-deazaadenosine, 7-deazaguanosine, 6-thioguanosine, and 6-thio-7-deazaguanosine. In another embodiment, the one or more nucleotides includes at least one of pseudouridine, 2-thiouridine, 4-thiouridine, 5-azauridine, 5-hydroxyuridine, 5-methyluridine, 5-aminouridine, 2-thiopseudouridine, 4-thiopseudouridine, 5-hydroxypseudouridine, 5-methylpseudouridine, and 5-aminopseudouridine and at least one of pseudoisocytidine, N4-methylcytidine, 2-thiocytidine, 5-azacytidine, 5-hydroxycytidine, 5-aminocytidine, 5-methylcytidine, N4-methylpseudoisocytidine, 2-thiopseudoisocytidine, 5-hydroxypseudoisocytidine, 5-aminopseudoisocytidine, and 5-methylpseudoisocytidine. In still another embodiment, the one or more nucleotides include at least one of pseudouridine, 2-thiouridine, 4-thiouridine, 5-azauridine, 5-hydroxyuridine, 5-methyluridine, 5-aminouridine, 2-thiopseudouridine, 4-thiopseudouridine, 5-hydroxypseudouridine, and 5-methylpseudouridine, 5-aminopseudouridine and at least one of pseudoisocytidine, N4-methylcytidine, 2-thiocytidine, 5-azacytidine, 5-hydroxycytidine, 5-aminocytidine, 5-methylcytidine, N4-methylpseudoisocytidine, 2-thiopseudoisocytidine, 5-hydroxypseudoisocytidine, 5-aminopseudoisocytidine, and 5-methylpseudoisocytidine and at least one of 7-deazaguanosine, 6-thioguanosine, 6-thio-7-deazaguanosine, and 5-methoxyuridine. In yet another embodiment, the one or more nucleotides includes 5-methylcytidine and 7-deazaguanosine. In another embodiment, the one or more nucleotides also includes pseudouridine or 4-thiouridine or 5-methyluridine or 5-aminouridine or 4-thiopseudouridine or 5-methylpseudouridine or 5-aminopseudouridine. In a still another embodiment, the one or more nucleotides also includes 7-deazaadenosine. In another embodiment, the one or more nucleotides includes pseudoisocytidine and 7-deazaguanosine and 4-thiouridine. In yet another embodiment, the one or more nucleotides includes pseudoisocytidine or 7-deazaguanosine and pseudouridine. In still another embodiment, the one or more nucleotides includes 5-methyluridine and 5-methylcytidine and 7-deazaguanosine. In a further embodiment, the one or more nucleotides includes pseudouridine or 5-methylpseudouridine and 5-methylcytidine and 7-deazaguanosine. In another embodiment, the one or more nucleotides includes pseudoisocytidine and 7-deazaguanosine and pseudouridine. In one embodiment, the RNA comprising one or more non-canonical nucleotides is present in vivo.

Certain non-canonical nucleotides can be incorporated more efficiently than other non-canonical nucleotides into RNA molecules by RNA polymerases that are commonly used for in vitro transcription, due in part to the tendency of these certain non-canonical nucleotides to participate in standard base-pairing interactions and base-stacking interactions, and to interact with the RNA polymerase in a manner similar to that in which the corresponding canonical nucleotide interacts with the RNA polymerase. As a result, certain nucleotide mixtures containing one or more non-canonical nucleotides can be beneficial in part because in vitro-transcription reactions containing these nucleotide mixtures can yield a large quantity of RNA. Certain embodiments are therefore directed to a nucleotide mixture containing one or more nucleotides that includes one or more substitutions at the 2C and/or 4C and/or 5C positions in the case of a pyrimidine or the 6C and/or 7N and/or 8C positions in the case of a purine. Nucleotide mixtures include, but are not limited to (numbers preceding each nucleotide indicate an illustrative fraction of the non-canonical nucleotide triphosphate in an in vitro-transcription reaction, for example, 0.2 pseudoisocytidine refers to a reaction containing adenosine-5'-triphosphate, guanosine-5'-triphosphate, uridine-5'-triphosphate, cytidine-5'-triphosphate, and pseudoisocytidine-5'-triphosphate, where pseudoisocytidine-5'-triphosphate is present in the reaction at an amount approximately equal to 0.2 times the total amount of pseudoisocytidine-5'-triphosphate+cytidine-5'-triphosphate that is present in the reaction, with amounts measured either on a molar or mass basis, and where more than one number preceding a nucleoside indicates a range of illustrative fractions): 1.0 pseudouridine, 0.1-0.8 2-thiouridine, 0.1-0.8 5-methyluridine, 0.2-1.0 5-hydroxyuridine, 0.2-1.0 5-methoxyuridine, 0.1-1.0 5-aminouridine, 0.1-1.0 4-thiouridine, 0.1-1.0 2-thiopseudouridine, 0.1-1.0 4-thiopseudouridine, 0.1-1.0 5-hydroxypseudouridine, 0.2-1 5-methylpseudouridine, 0.2-1.0 5-methoxypseudouridine, 0.1-1.0 5-aminopseudouridine, 0.2-1.0 2-thiocytidine, 0.1-0.8 pseudoisocytidine, 0.2-1.0 5-methylcytidine, 0.2-1.0 5-hydroxycytidine, 0.2-1.0 5-hydroxymethylcytidine, 0.2-1.0 5-methoxycytidine, 0.1-1.0 5-aminocytidine, 0.2-1.0 N4-methylcytidine, 0.2-1.0 5-methylpseudoisocytidine, 0.2-1.0 5-hydroxypseudoisocytidine, 0.2-1.0 5-aminopseudoisocytidine, 0.2-1.0 N4-methylpseudoisocytidine, 0.2-1.0 2-thiopseudoisocytidine, 0.2-1.0 7-deazaguanosine, 0.2-1.0 6-thioguanosine, 0.2-1.0 6-thio-7-deazaguanosine, 0.2-1.0 8-azaguanosine, 0.2-1.0 7-deaza-8-azaguanosine, 0.2-1.0 6-thio-8-azaguanosine, 0.1-0.5 7-deazaadenosine, and 0.1-0.5 N6-methyladenosine.

In embodiments, the RNA comprising one or more non-canonical nucleotides composition or synthetic polynucleotide composition (e.g., which may be prepared by in vitro transcription) contains substantially or entirely the canonical nucleotide at positions having adenine or "A" in the genetic code. The term "substantially" in this context refers to at least 90%. In these embodiments, the RNA composition or synthetic polynucleotide composition may further contain (e.g., consist of) 7-deazaguanosine at positions with "G" in the genetic code as well as the corresponding canonical nucleotide "G", and the canonical and non-canonical nucleotide at positions with G may be in the range of 5:1 to 1:5, or in embodiments in the range of 2:1 to 1:2. In these embodiments, the RNA composition or synthetic polynucleotide composition may further contain (e.g., consist of) one or more (e.g., two, three or four) of 5-hydroxycytidine, 5-methylcytidine, 5-hydroxymethylcytidine, 5-carboxycytidine, 5-formylcytidine, 5-methoxycytidine at positions with "C" in the genetic code as well as the canonical nucleotide "C", and the canonical and non-canonical nucleotide at positions with C may be in the range of 5:1 to 1:5, or in embodiments in the range of 2:1 to 1:2. In embodiments, the level of non-canonical nucleotide at positions of "C" are as described in the preceding paragraph. In these embodiments, the RNA composition or synthetic polynucleotide composition may further contain (e.g., consist of) one or more (e.g., two, three, or four) of 5-hydroxyuridine, 5-methyluridine, 5-hydroxymethyluridine, 5-carboxyuridine, 5-formyluridine, 5-methoxyuridine, pseudouridine, 5-hydroxypseudouridine, 5-methylpseudouridine, 5-hydroxymethylpseudouridine, 5-carboxypseudouridine, 5-formylpseudouridine, and 5-methoxypseudouridine at positions with "U" in the genetic code as well as the canonical nucleotide "U", and the canonical and non-canonical nucleotide at positions with "U" may be in the range of 5:1 to 1:5, or in some embodiments in the range of 2:1 to 1:2. In embodiments, the level of non-canonical nucleotide at positions of "U" are as described in the preceding paragraph.

Combining certain non-canonical nucleotides can be beneficial in part because the contribution of non-canonical nucleotides to lowering the toxicity of RNA molecules can be additive. Embodiments are therefore directed to a nucleotide mixture, where the nucleotide mixture contains more than one of the non-canonical nucleotides listed above, for example, the nucleotide mixture contains both pseudoisocytidine and 7-deazaguanosine or the nucleotide mixture contains both N4-methylcytidine and 7-deazaguanosine, etc. In one embodiment, the nucleotide mixture contains more than one of the non-canonical nucleotides listed above, and each of the non-canonical nucleotides is present in the mixture at the fraction listed above, for example, the nucleotide mixture contains 0.1-0.8 pseudoisocytidine and 0.2-1.0 7-deazaguanosine or the nucleotide mixture contains 0.2-1.0 N4-methylcytidine and 0.2-1.0 7-deazaguanosine, etc.

In certain situations, for example, when it may not be necessary or desirable to maximize the yield of an in vitro-transcription reaction, nucleotide fractions other than those given above may be used. The illustrative fractions and ranges of fractions listed above relate to nucleotide-triphosphate solutions of typical purity (greater than 90% purity). Larger fractions of these and other nucleotides can be used by using nucleotide-triphosphate solutions of greater purity, for example, greater than about 95% purity or greater than about 98% purity or greater than about 99% purity or greater than about 99.5% purity, which can be achieved, for example, by purifying the nucleotide triphosphate solution using existing chemical-purification technologies such as high-pressure liquid chromatography (HPLC) or by other means. In one embodiment, nucleotides with multiple isomers are purified to enrich the desired isomer.

Other embodiments are directed to a method for inducing a cell in vivo to express a protein of interest by contacting the cell with the present compounds (e.g. of Formulae I-XVI) and/or pharmaceutical compositions and/or lipid aggregates and/or lipid carriers and a RNA molecule that contains one or more non-canonical nucleotides that includes one or more substitutions at the 2C and/or 4C and/or 5C positions in the case of a pyrimidine or the 6C and/or 7N and/or 8C positions in the case of a purine. Still other embodiments are directed to a method for transfecting, reprogramming, and/or gene-editing a cell in vivo by contacting the cell with the present compounds (e.g. of Formulae I-XVI) and/or pharmaceutical compositions and/or lipid aggregates and/or lipid carriers and a RNA molecule that contains one or more non-canonical nucleotides that includes one or more substitutions at the 2C and/or 4C and/or 5C positions in the case of a pyrimidine or the 6C and/or 7N and/or 8C positions in the case of a purine. In one embodiment, the RNA molecule is produced by in vitro transcription. In one embodiment, the RNA molecule encodes one or more reprogramming factors. In another embodiment, the one or more reprogramming factors includes Oct4 protein. In another embodiment, the cell is also contacted with a RNA molecule that encodes Sox2 protein. In yet another embodiment, the cell is also contacted with a RNA molecule that encodes Klf4 protein. In yet another embodiment, the cell is also contacted with a RNA molecule that encodes c-Myc protein. In yet another embodiment, the cell is also contacted with a RNA molecule that encodes Lin28 protein.

Enzymes such as T7 RNA polymerase may preferentially incorporate canonical nucleotides in an in vitro-transcription reaction containing both canonical and non-canonical nucleotides. As a result, an in vitro-transcription reaction containing a certain fraction of a non-canonical nucleotide may yield RNA containing a different, often lower, fraction of the non-canonical nucleotide than the fraction at which the non-canonical nucleotide was present in the reaction. In certain embodiments, references to nucleotide incorporation fractions (for example, "a synthetic RNA molecule containing 50% pseudoisocytidine" or "0.1-0.8 pseudoisocytidine") therefore can refer both to RNA molecules containing the stated fraction of the nucleotide, and to RNA molecules synthesized in a reaction containing the stated fraction of the nucleotide (or nucleotide derivative, for example, nucleotide-triphosphate), even though such a reaction may yield RNA containing a different fraction of the nucleotide than the fraction at which the non-canonical nucleotide was present in the reaction.

Different nucleotide sequences can encode the same protein by utilizing alternative codons. In certain embodiments, references to nucleotide incorporation fractions therefore can refer both to RNA molecules containing the stated fraction of the nucleotide, and to RNA molecules encoding the same protein as a different RNA molecule, where the different RNA molecule contains the stated fraction of the nucleotide.

The non-canonical nucleotide members of the 5-methylcytidine de-methylation pathway, when incorporated into synthetic RNA, can increase the efficiency with which the synthetic RNA can be translated into protein in vivo, and can decrease the toxicity of the synthetic RNA in vivo. These non-canonical nucleotides include, for example: 5-methylcytidine, 5-hydroxymethylcytidine, 5-formylcytidine, and 5-carboxycytidine (a.k.a. "cytidine-5-carboxylic acid"). Certain embodiments are therefore directed to a nucleic acid. In embodiments, the nucleic acid is present in vivo. In one embodiment, the nucleic acid is a synthetic RNA molecule. In another embodiment, the nucleic acid comprises one or more non-canonical nucleotides. In one embodiment, the nucleic acid comprises one or more non-canonical nucleotide members of the 5-methylcytidine de-methylation pathway. In another embodiment, the nucleic acid comprises at least one of 5-methylcytidine, 5-hydroxymethylcytidine, 5-formylcytidine, and 5-carboxycytidine or a derivative thereof. In a further embodiment, the nucleic acid comprises at least one of pseudouridine, 5-methylpseudouridine, 5-hydroxyuridine, 5-methyluridine, 5-methylcytidine, 5-hydroxymethylcytidine, N4-methylcytidine, N4-acetylcytidine, and 7-deazaguanosine or a derivative thereof.

5-methylcytidine De-Methylation Pathway

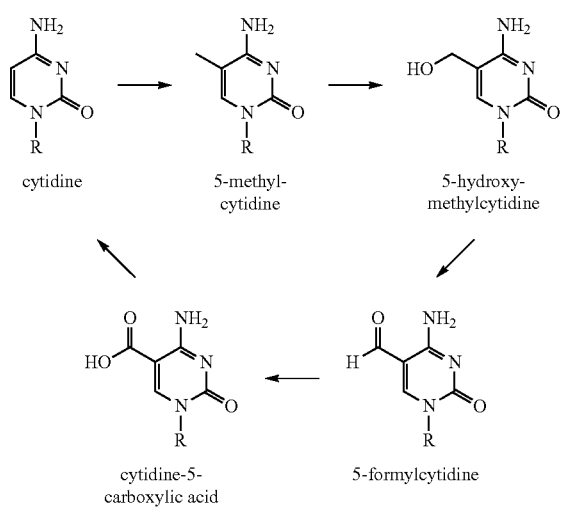

Certain combinations of non-canonical nucleotides can be particularly effective at increasing the efficiency with which synthetic RNA can be translated into protein in vivo, and decreasing the toxicity of synthetic RNA in vivo, for example, the combinations: 5-methyluridine and 5-methylcytidine, 5-hydroxyuridine and 5-methylcytidine, 5-hydroxyuridine and 5-hydroxymethylcytidine, 5-methyluridine and 7-deazaguanosine, 5-methylcytidine and 7-deazaguanosine, 5-methyluridine, 5-methylcytidine, and 7-deazaguanosine, and 5-methyluridine, 5-hydroxymethylcytidine, and 7-deazaguanosine. Certain embodiments are therefore directed to a nucleic acid comprising at least two of 5-methyluridine, 5-methylcytidine, 5-hydroxymethylcytidine, and 7-deazaguanosine or one or more derivatives thereof. Other embodiments are directed to a nucleic acid comprising at least three of 5-methyluridine, 5-methylcytidine, 5-hydroxymethylcytidine, and 7-deazaguanosine or one or more derivatives thereof. Other embodiments are directed to a nucleic acid comprising all of 5-methyluridine, 5-methylcytidine, 5-hydroxymethylcytidine, and 7-deazaguanosine or one or more derivatives thereof. In one embodiment, the nucleic acid comprises one or more 5-methyluridine residues, one or more 5-methylcytidine residues, and one or more 7-deazaguanosine residues or one or more 5-methyluridine residues, one or more 5-hydroxymethylcytidine residues, and one or more 7-deazaguanosine residues.

Synthetic RNA molecules containing certain fractions of certain non-canonical nucleotides and combinations thereof can exhibit particularly high translation efficiency and low toxicity in vivo. Certain embodiments are therefore directed to a nucleic acid comprising at least one of one or more uridine residues, one or more cytidine residues, and one or more guanosine residues, and comprising one or more non-canonical nucleotides. In one embodiment, between about 20% and about 80% of the uridine residues are 5-methyluridine residues. In another embodiment, between about 30% and about 50% of the uridine residues are 5-methyluridine residues. In a further embodiment, about 40% of the uridine residues are 5-methyluridine residues. In one embodiment, between about 60% and about 80% of the cytidine residues are 5-methylcytidine residues. In another embodiment, between about 80% and about 100% of the cytidine residues are 5-methylcytidine residues. In a further embodiment, about 100% of the cytidine residues are 5-methylcytidine residues. In a still further embodiment, between about 20% and about 100% of the cytidine residues are 5-hydroxymethylcytidine residues. In one embodiment, between about 20% and about 80% of the guanosine residues are 7-deazaguanosine residues. In another embodiment, between about 40% and about 60% of the guanosine residues are 7-deazaguanosine residues. In a further embodiment, about 50% of the guanosine residues are 7-deazaguanosine residues. In one embodiment, between about 20% and about 80% or between about 30% and about 60% or about 40% of the cytidine residues are N4-methylcytidine and/or N4-acetylcytidine residues. In another embodiment, each cytidine residue is a 5-methylcytidine residue. In a further embodiment, about 100% of the cytidine residues are 5-methylcytidine residues and/or 5-hydroxymethylcytidine residues and/or N4-methylcytidine residues and/or N4-acetylcytidine residues and/or one or more derivatives thereof. In a still further embodiment, about 40% of the uridine residues are 5-methyluridine residues, between about 20% and about 100% of the cytidine residues are N4-methylcytidine and/or N4-acetylcytidine residues, and about 50% of the guanosine residues are 7-deazaguanosine residues. In one embodiment, about 40% of the uridine residues are 5-methyluridine residues and about 100% of the cytidine residues are 5-methylcytidine residues. In another embodiment, about 40% of the uridine residues are 5-methyluridine residues and about 50% of the guanosine residues are 7-deazaguanosine residues. In a further embodiment, about 100% of the cytidine residues are 5-methylcytidine residues and about 50% of the guanosine residues are 7-deazaguanosine residues. In a further embodiment, about 100% of the uridine residues are 5-hydroxyuridine residues. In one embodiment, about 40% of the uridine residues are 5-methyluridine residues, about 100% of the cytidine residues are 5-methylcytidine residues, and about 50% of the guanosine residues are 7-deazaguanosine residues. In another embodiment, about 40% of the uridine residues are 5-methyluridine residues, between about 20% and about 100% of the cytidine residues are 5-hydroxymethylcytidine residues, and about 50% of the guanosine residues are 7-deazaguanosine residues. In embodiments, less than 100% of the cytidine residues are 5-methylcytidine residues. In other embodiments, less than 100% of the cytidine residues are 5-hydroxymethylcytidine residues. In one embodiment, each uridine residue in the synthetic RNA molecule is a pseudouridine residue or a 5-methylpseudouridine residue. In another embodiment, about 100% of the uridine residues are pseudouridine residues and/or 5-methylpseudouridine residues. In a further embodiment, about 100% of the uridine residues are pseudouridine residues and/or 5-methylpseudouridine residues, about 100% of the cytidine residues are 5-methylcytidine residues, and about 50% of the guanosine residues are 7-deazaguanosine residues.

Other non-canonical nucleotides that can be used in place of or in combination with 5-methyluridine include, but are not limited to pseudouridine, 5-hydroxyuridine, 5-hydroxypseudouridine, 5-methoxyuridine, 5-methoxypseudouridine, 5-carboxyuridine, 5-carboxypseudouridine, 5-formyluridine, 5-formylpseudouridine, 5-hydroxymethyluridine, 5-hydroxymethylpseudouridine, and 5-methylpseudouridine ("1-methylpseudouridine", "N1-methylpseudouridine") or one or more derivatives thereof. Other non-canonical nucleotides that can be used in place of or in combination with 5-methylcytidine and/or 5-hydroxymethylcytidine include, but are not limited to pseudoisocytidine, 5-methylpseudoisocytidine, 5-hydroxymethylcytidine, 5-formylcytidine, 5-carboxycytidine, 5-methoxycytidine, N4-methylcytidine, N4-acetylcytidine or one or more derivatives thereof. In certain embodiments, for example, when performing only a single transfection, injection or delivery or when the cells, tissue, organ or patient being transfected, injected or delivered to are not particularly sensitive to transfection-associated toxicity or innate-immune signaling, the fractions of non-canonical nucleotides can be reduced. Reducing the fraction of non-canonical nucleotides can be beneficial, in part, because reducing the fraction of non-canonical nucleotides can reduce the cost of the nucleic acid. In certain situations, for example, when minimal immunogenicity of the nucleic acid is desired, the fractions of non-canonical nucleotides can be increased.

Enzymes such as T7 RNA polymerase may preferentially incorporate canonical nucleotides in an in vitro-transcription reaction containing both canonical and non-canonical nucleotides. As a result, an in vitro-transcription reaction containing a certain fraction of a non-canonical nucleotide may yield RNA containing a different, often lower, fraction of the non-canonical nucleotide than the fraction at which the non-canonical nucleotide was present in the reaction. In certain embodiments, references to nucleotide incorporation fractions (for example, "50% 5-methyluridine") therefore can refer both to nucleic acids containing the stated fraction of the nucleotide, and to nucleic acids synthesized in a reaction containing the stated fraction of the nucleotide (or nucleotide derivative, for example, nucleotide-triphosphate), even though such a reaction may yield a nucleic acid containing a different fraction of the nucleotide than the fraction at which the non-canonical nucleotide was present in the reaction. In addition, different nucleotide sequences can encode the same protein by utilizing alternative codons. In certain embodiments, references to nucleotide incorporation fractions therefore can refer both to nucleic acids containing the stated fraction of the nucleotide, and to nucleic acids encoding the same protein as a different nucleic acid, where the different nucleic acid contains the stated fraction of the nucleotide.

Certain embodiments are directed to a nucleic acid comprising a 5'-cap structure selected from Cap 0, Cap 1, Cap 2, and Cap 3 or a derivative thereof. In one embodiment, the nucleic acid comprises one or more UTRs. In another embodiment, the one or more UTRs increase the stability of the nucleic acid. In a further embodiment, the one or more UTRs comprise an alpha-globin or beta-globin 5'-UTR. In a still further embodiment, the one or more UTRs comprise an alpha-globin or beta-globin 3'-UTR. In a still further embodiment, the synthetic RNA molecule comprises an alpha-globin or beta-globin 5'-UTR and an alpha-globin or beta-globin 3'-UTR. Certain embodiments are directed to a nucleic acid comprising a post-transcriptional regulatory element. In one embodiment, the post-transcriptional regulatory element is selected from Woodchuck Hepatitis Virus (WHP) Posttranscriptional Regulatory Element (WPRE), Hepatitis B virus Posttranscriptional Regulatory Element (HPRE), chicken lysozyme matrix attachment region (cMAR), and 5'-DNase I-hypersensitive sites 4 (cHS4). In another embodiment, the one or more UTRs include WPRE. In a further embodiment, the synthetic RNA molecule comprises an alpha-globin or beta-globin 5'-UTR and a 3'-UTR comprising WPRE. In a still further embodiment, the synthetic RNA molecule comprises one or more copies of WPRE in addition to an alpha-globin or beta-globin 5'-UTR and an alpha-globin or beta-globin 3'-UTR. Illustrative WPRE elements of the invention are SEQ ID NO: 813, SEQ ID NO: 814, SEQ ID NO: 815, SEQ ID NO: 816, SEQ ID NO: 817, and SEQ ID NO: 818.

In one embodiment, the 5'-UTR comprises a Kozak sequence that is substantially similar to the Kozak consensus sequence. In another embodiment, the nucleic acid comprises a 3'-poly(A) tail. In a further embodiment, the 3'-poly (A) tail is between about 20 nt and about 250 nt or between about 120 nt and about 150 nt long. In a further embodiment, the 3'-poly(A) tail is about 20 nt, or about 30 nt, or about 40 nt, or about 50 nt, or about 60 nt, or about 70 nt, or about 80 nt, or about 90 nt, or about 100 nt, or about 110 nt, or about 120 nt, or about 130 nt, or about 140 nt, or about 150 nt, or about 160 nt, or about 170 nt, or about 180 nt, or about 190 nt, or about 200 nt, or about 210 nt, or about 220 nt, or about 230 nt, or about 240 nt, or about 250 nt long.

Poly(A) tails produced by poly(A) polymerase may vary in length depending on reaction conditions including reaction time and enzyme activity, and that an enzymatic tailing reaction may produce a mixture of RNA molecules having poly(A) tails of varied lengths. Certain embodiments are directed to a synthetic RNA molecule containing a tail of about 10, about 20, about 30, about 40, about 50, about 75, about 100, about 125, about 150, about 175, about 200, about 225, about 250, about 275, about 300, about 325, about 350, or about 400, or more than about 400 nucleotides. In one embodiment, the tail is a poly(A) tail. Other embodiments are directed to a tail containing fewer than about 10 nucleotides.

Synthesizing RNA using a template that encodes a tail can enable increased control over the length of the tail and reduced variability within or among reactions. Certain embodiments are therefore directed to a template encoding a tail. In certain embodiments, the tail contains about 10, about 20, about 30, about 40, about 50, about 75, about 100, about 125, about 150, about 175, about 200, about 225, about 250, about 275, about 300, about 325, about 350, or about 400 nucleotides. Other embodiments are directed to a synthetic RNA molecule synthesized using a template that encodes a tail.

Inclusion of nucleotides other than adenosine within the tail can enhance stability and/or translation efficiency of a synthetic RNA molecule and improve fidelity of template DNA production in bacteria. Some embodiments are therefore directed to a synthetic RNA molecule comprising a tail, where the tail comprises adenosine nucleotides and one or more other nucleotides. Other embodiments are directed to a template that encodes a tail, where the tail comprises deoxyadenosine nucleotides and one or more other nucleotides. In one embodiment, the tail includes guanosine nucleotides. In another embodiment, the tail includes cytosine nucleotides. In a further embodiment, the tail includes uridine nucleotides. In a still further embodiment, the tail includes one or more chemically modified nucleotides and/ or non-canonical nucleotides. In various embodiments, the other nucleotides are incorporated at regularly spaced intervals, or at random intervals, or in pairs or groups of adjacent nucleotides separated by one or more adenosine nucleotides. In one embodiment, the tail includes deoxyguanosine nucleotides. In another embodiment, the tail includes deoxycytosine nucleotides. In a further embodiment, the tail includes deoxyuridine nucleotides. In various embodiments, the other nucleotides are incorporated at regularly spaced intervals, or at random intervals, or in pairs or groups of adjacent nucleotides separated by one or more deoxyadenosine nucleotides. In embodiments, the tail region is comprised of about 2%-10% non-uridine nucleotides, about 10%-20% non-uridine nucleotides, about 20%-35% non-uridine nucleotides.

Inclusion of a stem-loop structure before or after the tail can enhance stability and/or translation efficiency of a synthetic RNA molecule. Some embodiments are therefore directed to a synthetic RNA molecule comprising a tail and a stem-loop structure. In various embodiments, the stem-loop structure appears before the tail, after the tail, or before or after the tail. In certain embodiments, the stem-loop structure is a histone 3' UTR stem-loop. In certain embodiments, the sequence of the stem-loop structure is A(G(Y(Y(Y(UUYUNA)R)R)R)C)A (SEQ ID NO: 860) or M(G(G(C(Y(C(UUUUMA)G)R)G)C)C)A (SEQ ID NO: 861) or A(G(G(Y(Y(Y(UHHUHA)R)R)R)C)C)A (SEQ ID NO: 862).

An aspect of the present invention is a composition comprising a DNA template comprising: (a) a sequence encoding a protein, (b) a tail region comprising deoxyadenosine nucleotides and one or more other nucleotides, and (c) a restriction enzyme binding site.

In embodiments, the length of the tail region is between about 80 base pairs and about 120 base pairs, about 120 base pairs and about 160 base pairs, about 160 base pairs and about 200 base pairs, about 200 base pairs and about 240 base pairs, about 240 base pairs and about 280 base pairs, or about 280 base pairs and about 320 base pairs.

In embodiments, the length of the tail region is greater than 320 base pairs.

In embodiments, the tail region comprises about 1%, about 2%, about 5%, about 10%, about 15%, about 20%, about 25%, about 30%, about 35%, about 40%, about 45%, or about 50% guanosine residues.

In embodiments, the tail region comprises about 1%, about 2%, about 5%, about 10%, about 15%, about 20%, about 25%, about 30%, about 35%, about 40%, about 45%, or about 50% cytidine residues.

In embodiments, the tail region comprises about 1%, about 2%, about 5%, about 10%, about 15%, about 20%, about 25%, about 30%, about 35%, about 40%, about 45%, or about 50% uridine residues.

In any of the preceding embodiments and aspects, the tail region comprises about 99%, about 98%, about 95%, about 90%, about 85%, about 80%, about 75%, about 70%, about 65%, about 60%, about 55%, or about 50% adenosine residues.

In embodiments, the synthetic RNA comprises about 200 nucleotides to about 5000 nucleotides.

In embodiments, the synthetic RNA comprises from about 500 to about 2000 nucleotides, or about 500 to about 1500 nucleotides, or about 500 to about 1000 nucleotides.

Proteins of Interest

In embodiments, the compound, pharmaceutical composition, or lipid aggregate described herein is complexed with or associates with a nucleic acid (e.g. DNA or RNA, e.g. mRNA) and the nucleic acid encodes a recombinant protein of interest.

In embodiments, the recombinant protein of interest is a soluble protein.

In embodiments, the protein of interest is selected from Table 2B.

In embodiments, the soluble protein is one or more reprogramming factors. In embodiments, the one or more reprogramming factors is selected from Oct4, Sox2, Klf4, c-Myc, l-Myc, Tert, Nanog, Lin28, Utf1, Aicda, miR200 micro-RNA, miR302 micro-RNA, miR367 micro-RNA, miR369 micro-RNA and biologically active fragments, analogues, variants and family-members thereof.

In embodiments, the recombinant protein of interest is a gene-editing protein. In embodiments, the gene-editing protein is selected from a nuclease, a transcription activator-like effector nuclease (TALEN), a zinc-finger nuclease, a meganuclease, a nickase, a clustered regularly interspaced short palindromic repeat (CRISPR)-associated protein, CRISPR/Cas9, Cas9, xCas9, Cas12a (Cpf1), Cas13a, Cas14, CasX, CasY, a Class 1 Cas protein, a Class 2 Cas protein, and MAD7, or a natural or engineered variant, family-member, orthologue, fragment or fusion construct thereof.

In embodiments, the gene-editing protein comprises a DNA-binding domain comprising a plurality of repeat sequences and at least one of the repeat sequences comprises the amino acid sequence LTPvQVVAIAwxyza (SEQ ID NO: 819), wherein each of "v", "w", "x", and "y", is independently selected from A, C, D, E, F, G, H, I, K, L, M, N, P, Q, R, S, T, V, W, Y and null; "z" is selected from GGRPALE (SEQ ID NO: 820), GGKQALE (SEQ ID NO: 821), GGKQALETVQRLLPVLCQD (SEQ ID NO: 630), GGKQALETVQRLLPVLCQA (SEQ ID NO: 631), GKQALETVQRLLPVLCQD (SEQ ID NO: 824), and GKQALETVQRLLPVLCQA (SEQ ID NO: 825), and "a" is any four consecutive amino acids or null. In embodiments, "v" is Q, D or E, "w" is S or N, "x" is I, H, N, or I, and "y" is D, A, I, N, H, K, S, G or null. In embodiments, repeat sequence is between 36 and 39 amino acids long (e.g. 36, or 37, or 38, or 39 amino acids long).

In embodiments, α comprises at least one glycine (G) residue. In embodiments, α comprises at least one histidine (H) residue. In embodiments, α comprises at least one histidine (H) residue at any one of positions 33, 34, or 35. In embodiments, α comprises at least one aspartic acid (D) residue. In embodiments, α comprises at least one, or two, or three of a glycine (G) residue, a histidine (H) residue, and an aspartic acid (D) residue.

In embodiments, α comprises one or more hydrophilic residues, optionally selected from: a polar and positively charged hydrophilic amino acid, optionally selected from arginine (R) and lysine (K); a polar and neutral of charge hydrophilic amino acid, optionally selected from asparagine (N), glutamine (Q), serine (S), threonine (T), proline (P), and cysteine (C); a polar and negatively charged hydrophilic amino acid, optionally selected from aspartate (D) and glutamate (E), and an aromatic, polar and positively charged hydrophilic amino acid, optionally selected from histidine (H).

In some embodiments, α comprises one or more polar and positively charged hydrophilic amino acids selected from arginine (R) and lysine (K). In some embodiments, α comprises one or more polar and neutral of charge hydrophilic amino acids selected from asparagine (N), glutamine (Q), serine (S), threonine (T), proline (P), and cysteine (C). In some embodiments, α comprises one or more polar and negatively charged hydrophilic amino acids selected from aspartate (D) and glutamate (E). In some embodiments, α comprises one or more aromatic, polar and positively charged hydrophilic amino acids selected from histidine (H).

In embodiments, α comprises one or more hydrophobic residues, optionally selected from: a hydrophobic, aliphatic amino acid, optionally selected from glycine (G), alanine (A), leucine (L), isoleucine (I), methionine (M), and valine (V), and a hydrophobic, aromatic amino acid, optionally selected from phenylalanine (F), tryptophan (W), and tyrosine (Y). In some embodiments, α comprises one or more hydrophobic, aliphatic amino acids selected from glycine (G), alanine (A), leucine (L), isoleucine (I), methionine (M), and valine (V). In some embodiments, α comprises one or more aromatic amino acids selected from phenylalanine (F), tryptophan (W), and tyrosine (Y).

In embodiments, α is defined by GabG, where "a" and "b" is independently selected from A, C, D, E, F, G, H, I, K, L, M, N, P, Q, R, S, T, V, W, Y and null.

In embodiments, α is selected from GHGG (SEQ ID NO: 828), HGSG (SEQ ID NO: 829), HGGG (SEQ ID NO: 830), GGHD (SEQ ID NO: 831), GAHD (SEQ ID NO: 832), AHDG (SEQ ID NO: 833), PHDG (SEQ ID NO: 834), GPHD (SEQ ID NO: 835), GHGP (SEQ ID NO: 836), PHGG (SEQ ID NO: 837), PHGP (SEQ ID NO: 838), AHGA (SEQ ID NO: 839), LHGA (SEQ ID NO: 840), VHGA (SEQ ID NO: 841), IVHG (SEQ ID NO: 842), IHGM (SEQ ID NO: 843), RDHG (SEQ ID NO: 845), RHGE (SEQ ID NO: 846), HRGE (SEQ ID NO: 847), RHGD (SEQ ID NO: 848), HRGD (SEQ ID NO: 849), GPYE (SEQ ID NO: 850), NHGG (SEQ ID NO: 851), THGG (SEQ ID NO: 852), GTHG (SEQ ID NO: 853), GSGS (SEQ ID NO: 854), GSGG (SEQ ID NO: 855), GGGG (SEQ ID NO: 856), GRGG (SEQ ID NO: 857), and GKGG (SEQ ID NO: 858).

In embodiments, the gene-editing protein comprises a DNA-binding domain comprising a plurality of repeat sequences and at least one of the repeat sequences comprises the amino acid sequence: LTPvQVVAIAwxyzGHGG (SEQ ID NO:629) and is between 36 and 39 amino acids long, wherein: "v" is Q, D or E, "w" is S or N, "x" is H, N, or I, "y" is D, A, I, N, G, H, K, S, or null, and "z" is GGKQALETVQRLLPVLCQD (SEQ ID NO: 630) or GGKQALETVQRLLPVLCQA (SEQ ID NO: 631).

In embodiments, the gene-editing protein further comprises a nuclease domain comprising a catalytic domain of a nuclease.

In embodiments, the gene-editing protein is capable of creating a single-strand or double-strand break in the gene.

In embodiments, the single-strand or double-strand break causes persistent altered splicing of the gene.

It has now been discovered that incorporation of microRNA binding sites in the sequence of synthetic RNA molecules can render the encoded protein immunotolerated. Certain embodiments are therefore directed to a synthetic RNA molecule comprising a microRNA binding site. In one embodiment, the microRNA binding site is a miR223 microRNA binding site. In another embodiment the microRNA binding site is a miR142 micro-RNA binding site (mIR-142 has the sequence of SEQ ID NO: 810). In some embodiments, the microRNA binding site is present in the 3'-UTR of the synthetic RNA molecule. In other embodiments, the 3'-UTR of the synthetic RNA molecule comprises multiple microRNA binding sites. In still other embodiments, the 3'-UTR of the synthetic RNA molecule comprises multiple miR142 micro-RNA binding sites. In certain embodiments, the 3'-UTR of the synthetic RNA molecule comprises multiple miR223 micro-RNA binding sites. In one embodiment, the miR142 micro-RNA binding site is TCCATAAAGTAGGAAACACTACA (SEQ ID NO: 811). In another embodiment, the 3'-UTR of the synthetic RNA molecule comprises four copies of the miR142 micro-RNA binding site (SEQ ID NO: 812). In a further embodiment, the microRNA binding sites are separated by two or more nucleotides. In one embodiment, the encoded protein is a gene-editing protein. In another embodiment, the encoded protein is expressed preferentially in non-hematopoeitic cells. In certain embodiments, the encoded protein is rendered immunotolerated. In other embodiments, the encoded protein is absent or is present at lower than normal levels in a subject. In still other embodiments, the encoded protein is a gene-editing protein, and a vector for repairing or inserting a gene is delivered to a cell. In some embodiments, the gene product is rendered immunotolerated.

Some embodiments are directed toward the provocation and/or stimulation and/or propagation of an immune response. In some embodiments, the recombinant protein of interest is an antigen. In some embodiments, the recombinant protein of interest provides acquired immunity to one or more diseases, optionally infectious diseases. In some embodiments, the immune system mounts a response to the recombinant protein of interest. In some embodiments, the recombinant protein of interest is derived from a pathogen or toxin; in some other embodiments, the recombinant protein of interest is a synthetic mimic of a pathogen or toxin. In some embodiments, the recombinant protein of interest is a fusion protein, optionally comprising, independently, a sequence derived from or mimicking a pathogen or toxin, and/or a sequence known to stimulate immune response. In some embodiments, the subject is rendered immune or resistant to certain pathogens or toxins after administration of synthetic RNAs encoding an antigen of interest.

In various embodiments, the pathogen is coronavirus. Coronaviruses (CoVs) are members of the family Coronaviridae, including betacoronavirus and alphacoronavirus-respiratory pathogens.

In embodiments, the coronavirus protein is a betacoronavirus protein or an alphacoronavirus protein. In some embodiments, the betacoronavirus protein is selected from a SARS-CoV-2, SARS-CoV, MERS-CoV, HCoV-HKU1, and HCoV-0043 protein, or an antigenic fragment thereof. In some embodiments, the alphacoronavirus protein is selected from a HCoV-NL63 and HCoV-229E protein, or an antigenic fragment thereof.

In some embodiments, the coronavirus is a betacoronavirus or an alphacoronavirus. In some embodiments, the betacoronavirus is selected from a SARS-CoV-2, SARS-CoV, MERS-CoV, HCoV-HKU1, and HCoV-0043. In embodiments, the alphacoronavirus is selected from a HCoV-NL63 and HCoV-229E. In embodiments, the coronavirus is severe acute respiratory syndrome coronavirus 2 (SARS-CoV-2).

In some embodiments, the recombinant protein of interest is a coronavirus protein. In various embodiments, the coronavirus protein is a protein from SARS-CoV-2, such as, e.g., SARS-CoV-2 spike protein. In embodiments, the SARS-CoV-2 protein is selected from spike surface glycoprotein, membrane glycoprotein M, envelope protein E, and nucleocapsid phosphoprotein N, or an antigenic fragment thereof. In embodiments, the SARS-CoV-2 protein selected from spike surface glycoprotein comprises S1, S2 and S2'.

In some embodiments, the SARS-CoV-2 spike protein comprises the following amino acid sequence:

(SEQ ID NO: 100)

```
MFVFLVLLPLVSSQCVNLTTRTQLPPAYTNSFTRGVYYPDKVFRSSVLHS

TQDLFLPFFSNVTWFHAIHVSGTNGTKRFDNPVLPFNDGVYFASTEKSNI

IRGWIFGTTLDSKTQSLLIVNNATNVVIKVCEFQFCNDPFLGVYYHKNNK

SWMESEFRVYSSANNCTFEYVSQPFLMDLEGKQGNFKNLREFVFKNIDGY

FKIYSKHTPINLVRDLPQGFSALEPLVDLPIGINITRFQTLLALHRSYLT

PGDSSSGWTAGAAAYYVGYLQPRTFLLKYNENGTITDAVDCALDPLSETK

CTLKSFTVEKGIYQTSNFRVQPTESIVRFPNITNLCPFGEVFNATRFASV
```

-continued
YAWNRKRISNCVADYSVLYNSASFSTFKCYGVSPTKLNDLCFTNVYADSF

VIRGDEVRQIAPGQTGKIADYNYKLPDDFTGCVIAWNSNNLDSKVGGNYN

YLYRLFRKSNLKPFERDISTEIYQAGSTPCNGVEGFNCYFPLQSYGFQPT

NGVGYQPYRVVVLSFELLHAPATVCGPKKSTNLVKNKCVNFNFNGLTGTG

VLTESNKKFLPFQQFGRDIADTTDAVRDPQTLEILDITPCSFGGVSVITP

GTNTSNQVAVLYQDVNCTEVPVAIHADQLTPTWRVYSTGSNVFQTRAGCL

IGAEHVNNSYECDIPIGAGICASYQTQTNSPRRARSVASQSIIAYTMSLG

AENSVAYSNNSIAIPTNFTISVTTEILPVSMTKTSVDCTMYICGDSTECS

NLLLQYGSFCTQLNRALTGIAVEQDKNTQEVFAQVKQIYKTPPIKDFGGF

NFSQILPDPSKPSKRSFIEDLLFNKVTLADAGFIKQYGDCLGDIAARDLI

CAQKFNGLTVLPPLLTDEMIAQYTSALLAGTITSGWTFGAGAALQIPFAM

QMAYRFNGIGVTQNVLYENQKLIANQFNSAIGKIQDSLSSTASALGKLQD

VVNQNAQALNTLVKQLSSNFGAISSVLNDILSRLDKVEAEVQIDRLITGR

LQSLQTYVTQQLIRAAEIRASANLAATKMSECVLGQSKRVDFCGKGYHLM

SFPQSAPHGVVNFLHVTYVPAQEKNFTTAPAICHDGKAHFPREGVFVSNG

THWFVTQRNFYEPQIITTDNTFVSGNCDVVIGIVNNTVYDPLQPELDSFK

EELDKYFKNHTSPDVDLGDISGINASVVNIQKEIDRLNEVAKNLNESLID

LQELGKYEQYIKWPWYIWLGFIAGLIAIVMVTIMLCCMTSCCSCLKGCCS

CGSCCKFDEDDSEPVLKGVKLHYT.

In some embodiments, the envelope protein comprises the following amino acid sequence:

(SEQ ID NO: 101)
MYSFVSEETGTLIVNSVLLFLAFVVFLLVTLAILTALRLCAYCCNIVNVS

LVKPSFYVYSRVKNLNSSRVPDLLV.

In some embodiments, the membrane protein comprises the following amino acid sequence:

(SEQ ID NO: 102)
MADSNGTITVEELKKLLEQWNLVIGFLFLTWICLLQFAYANRNRFLYIIK

LIFLWLLWPVTLACFVLAAVYRINWITGGIAIAMACLVGLMWLSYFIASF

RLFARTRSMWSFNPETNILLNVPLHGTILTRPLLESELVIGAVILRGHLR

IAGHHLGRCDIKDLPKEITVATSRTLSYYKLGASQRVAGDSGFAAYSRYR

IGNYKLNTDHSSSSDNIALLVQ.

In some embodiments, the nucleocapsid phosphoprotein N comprises the following amino acid sequence:

(SEQ ID NO: 103)

MSDNGPQNQRNAPRITFGGPSDSTGSNQNGERSGARSKQRRPQGLPNNTA

SWFTALTQHGKEDLKFPRGQGVPINTNSSPDDQIGYYRRATRRIRGGDGK

MKDLSPRWYFYYLGTGPEAGLPYGANKDGIIWVATEGALNTPKDHIGTRN

PANNAAIVLQLPQGTTLPKGFYAEGSRGGSQASSRSSSRSRNSSRNSTPG

SSRGTSPARMAGNGGDAALALLLLDRLNQLESKMSGKGQQQQGQTVTKKS

AAEASKKPRQKRTATKAYNVTQAFGRRGPEQTQGNFGDQELIRQGTDYKH

-continued

WPQIAQFAPSASAFFGMSRIGMEVTPSGTWLTYTGAIKLDDKDPNFKDQV

ILLNKHIDAYKTFPPTEPKKDKKKKADETQALPQRQKKQQTVTLLPAADL

DDFSKQLQQSMSSADSTQA.

In embodiments, the spike surface glycoprotein comprises the amino acid sequence of SEQ ID NO: 100, membrane glycoprotein precursor M comprises the amino acid sequence of SEQ ID NO: 101, the envelope protein E comprises the amino acid sequence of SEQ ID NO: 102, and the nucleocapsid phosphoprotein N comprises the amino acid sequence of SEQ ID NO: 103, or an amino acid sequence at least about 90%, or at least about 95%, or at least about 97%, or at least about 98%, or at least about 99% identity with any of the foregoing, or an antigenic fragment of any of the foregoing.

In various embodiments, the SARS-CoV-2 protein may comprise an amino acid sequence that has at least about 60%, or at least about 61%, or at least about 62%, or at least about 63%, or at least about 64%, or at least about 65%, or at least about 66%, or at least about 67%, or at least about 68%, or at least about 69%, or at least about 70%, or at least about 71%, or at least about 72%, or at least about 73%, or at least about 74%, or at least about 75%, or at least about 76%, or at least about 77%, or at least about 78%, or at least about 79%, or at least about 80%, or at least about 81%, or at least about 82%, or at least about 83%, or at least about 84%, or at least about 85%, or at least about 86%, or at least about 87%, or at least about 88%, or at least about 89%, or at least about 90%, or at least about 91%, or at least about 92%, or at least about 93%, or at least about 94%, or at least about 95%, or at least about 96%, or at least about 97%, or at least about 98%, or at least about 99% sequence identity with any known wild type amino acid sequence of the SARS-CoV-2 protein or a SARS-CoV-2 amino acid sequence disclosed herein (e.g. about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, or about 99% sequence identity), e.g. relative to any one of SEQ ID NOs: 100, 101, 102, 103, or an antigenic fragment thereof.

In embodiments, a nucleic acid is provided that encodes a coronavirus protein, or an antigenic fragment thereof. The coronavirus protein can be any of the coronavirus proteins, including a betacoronavirus protein or an alphacoronavirus protein. The nucleic acid, without limitation, comprises RNA, such as, without limitation, mRNA. In some embodiments, the nucleic acid comprises, without limitation, DNA. The DNA can be associated with an AAV, encoding a coronavirus protein, or an antigenic fragment thereof.

In some embodiments, the nucleic acid comprises a vector that can comprise any type of nucleotides, including, but not limited to DNA and RNA, which may be single-stranded or double-stranded, synthesized or obtained in part from natural sources, and which in exemplary aspects contain natural, non-natural or altered nucleotides.

In embodiments, vaccines are provided against one or more diseases, pathogens, or toxins. In some embodiments, a vaccine in accordance with embodiments of the present disclosure generates protective antibody titers and/or T cell response to an encoded antigen. The encoded antigen can be, e.g., infections agent antigen, e.g. SARS-CoV-2 antigen. In some embodiments, a vaccine in accordance with embodiments of the present disclosure generates antigen-specific antibody titers (e.g., IgG, IgM and/or IgA) specific for an encoded antigen which can be infections agent antigen, e.g. SARS-CoV-2 antigen).

It has now been discovered that expression of certain factors along with a protein can render the encoded protein immunotolerated. In embodiments, the invention relates to the delivery of synthetic RNA molecules that are capable of inducing immunotoleration to an encoded protein by co-delivery of a factor that induces tolerance. In certain embodiments the co-delivered factors are expressed by synthetic RNA molecules. In some embodiments, a co-delivered factor is IL2 (SEQ ID NO:548). In some embodiments, a co-delivered factor is IL10 (SEQ ID NO:272 or SEQ ID NO:273) (e.g., without limitation, IL2, IL10, and/or tgf-β). In some embodiments, a co-delivered factor is TGFβ-1 (SEQ ID NO:190). In some embodiments, a co-delivered factor is TGFβ-2 (SEQ ID NO:191).

Gene Editing

In aspects, the present invention relates to a complex of one or more synthetic RNA molecules and a compound described herein (e.g. of Formulae I-XVI), where the one or more synthetic RNA molecules include at least one RNA molecule encoding one or more gene-editing protein is selected from a nuclease, a transcription activator-like effector nuclease (TALEN), a zinc-finger nuclease, a meganuclease, a nickase, a clustered regularly interspaced short palindromic repeat (CRISPR)-associated protein, CRISPR/Cas9, Cas9, xCas9, Cas12a (Cpf1), Cas13a, Cas14, CasX, CasY, a Class 1 Cas protein, a Class 2 Cas protein, and MAD7, or a natural or engineered variant, family-member, orthologue, fragment or fusion construct thereof.

In aspects, the present invention relates to a method for gene-editing a cell, comprising transfecting the cell with a complex of one or more synthetic RNA molecules and a compound described herein (e.g. of Formulae I-XVI), where the one or more synthetic RNA molecules include at least one RNA molecule encoding one or more gene-editing protein is selected from a nuclease, a transcription activator-like effector nuclease (TALEN), a zinc-finger nuclease, a meganuclease, a nickase, a clustered regularly interspaced short palindromic repeat (CRISPR)-associated protein, CRISPR/Cas9, Cas9, xCas9, Cas12a (Cpf1), Cas13a, Cas14, CasX, CasY, a Class 1 Cas protein, a Class 2 Cas protein, and MAD7, or a natural or engineered variant, family-member, orthologue, fragment or fusion construct thereof.

Several naturally occurring proteins contain DNA-binding domains that can recognize specific DNA sequences, for example, zinc fingers (ZFs) and transcription activator-like effectors (TALEs). Fusion proteins containing one or more of these DNA-binding domains and the cleavage domain of FokI endonuclease can be used to create a double-strand break in a desired region of DNA in a cell (see, e.g., US Patent Appl. Pub. No. US 2012/0064620, US Patent Appl. Pub. No. US 2011/0239315, U.S. Pat. No. 8,470,973, US Patent Appl. Pub. No. US 2013/0217119, U.S. Pat. No. 8,420,782, US Patent Appl. Pub. No. US 2011/0301073, US Patent Appl. Pub. No. US 2011/0145940, U.S. Pat. Nos. 8,450,471, 8,440,431, 8,440,432, and US Patent Appl. Pub. No. 2013/0122581, the contents of all of which are hereby incorporated by reference). Other gene-editing proteins include clustered regularly interspaced short palindromic repeat (CRISPR)-associated proteins. However, current methods for gene editing cells are inefficient and carry a risk of uncontrolled mutagenesis, making them undesirable for research, therapeutic or cosmetic use.

Some embodiments are directed to methods of gene-editing and/or gene correction employing the present compounds (e.g. of Formulae I-XVI) and/or pharmaceutical compositions and/or lipid aggregates and/or lipid carriers. For instance, in embodiments the present compounds (e.g. of Formulae I-XVI) and/or pharmaceutical compositions and/or lipid aggregates and/or lipid carriers associate with a synthetic RNA encoding a gene-editing protein and the resultant composition is used to gene-edit and/or gene correct a cell, e.g. ex vivo or in vivo.

Some embodiments encompass synthetic RNA-based gene-editing and/or gene correction, e.g. with RNA comprising non-canonical nucleotides, e.g. RNA encoding one or more of a nuclease, a transcription activator-like effector nuclease (TALEN), a zinc-finger nuclease, a meganuclease, a nickase, a clustered regularly interspaced short palindromic repeat (CRISPR)-associated protein a DNA-repair protein, a DNA-modification protein, a base-modification protein, a DNA methyltransferase, an protein that causes DNA demethylation, an enzyme for which DNA is a substrate or a natural or engineered variant, family-member, orthologue, fragment or fusion construct thereof. In embodiments, the efficiency of the gene-editing and/or gene correction is high, for example, higher than DNA-based gene editing and/or gene correction. In embodiments, the present methods of gene-editing and/or gene correction are efficient enough for in vivo application. In embodiments, the present methods of gene-editing and/or gene correction are efficient enough to not require cellular selection (e.g. selection of cells that have been edited).

In embodiments, the efficiency of gene-editing of the present methods is about 1%, or about 2%, or about 3%, or about 4%, or about 5%, or about 6%, or about 7%, or about 8%, or about 9%, or about 10%, or about 20%, or about 30%, or about 40%, or about 50%, or about 60%, or about 70%, or about 80%, or about 90%, or about 100%. In various embodiments, the efficiency of gene-correction of the present methods is about 1%, or about 2%, or about 3%, or about 4%, or about 5%, or about 6%, or about 7%, or about 8%, or about 9%, or about 10%, or about 20%, or about 30%, or about 40%, or about 50%, or about 60%, or about 70%, or about 80%, or about 90%, or about 100%

Some embodiments are directed to high-efficiency gene-editing proteins comprising engineered nuclease cleavage or DNA-modification domains. Other embodiments are directed to high-fidelity gene-editing proteins comprising engineered nuclease cleavage or DNA-modification domains. Various embodiments are directed to high-efficiency gene-editing proteins comprising engineered DNA-binding domains. Other embodiments are directed to high-fidelity gene-editing proteins comprising engineered DNA-binding domains. Still other embodiments are directed to gene-editing proteins comprising engineered repeat sequences. Some embodiments are directed to gene-editing proteins comprising one or more CRISPR associated family members. Some embodiments are directed to methods for altering the DNA sequence of a cell by transfecting the cell with or inducing the cell to express a gene-editing protein. Other embodiments are directed to methods for altering the DNA sequence of a cell that is present in an in vitro culture. Still further embodiments are directed to methods for altering the DNA sequence of a cell that is present in vivo.

Gene-editing proteins that comprise the StsI endonuclease cleavage domain (SEQ ID NO: 1) can exhibit substantially lower off-target activity in vivo than previously disclosed gene-editing proteins, while maintaining a high level of on-target activity in vivo. Other novel engineered proteins have also been discovered that can exhibit high on-target activity in vivo, low off-target activity in vivo, small size, solubility, and other desirable characteristics when they are used as the nuclease domain of a gene-editing protein: StsI-HA (SEQ ID NO: 2), StsI-HA2 (SEQ ID NO: 3), StsI-UHA (SEQ ID NO: 4), StsI-UHA2 (SEQ ID NO: 5), StsI-HF (SEQ ID NO: 6), and StsI-UHF (SEQ ID NO: 7). StsI-HA, StsI-HA2 (high activity), StsI-UHA, and StsI-UHA2 (ultra-high activity) can exhibit higher on-target activity in vivo than both wild-type StsI and wild-type FokI, due in part to specific amino-acid substitutions within the N-terminal region at the 34 and 61 positions, while StsI-HF (high fidelity) and StsI-UHF (ultra-high fidelity) can exhibit lower off-target activity in vivo than both wild-type StsI and wild-type FokI, due in part to specific amino-acid substitutions within the C-terminal region at the 141 and 152 positions.

Certain embodiments are therefore directed to a protein. In embodiments, the protein is present in vivo. In other embodiments, the protein comprises a nuclease domain. In one embodiment, the nuclease domain comprises one or more of the cleavage domain of FokI endonuclease (SEQ ID NO: 53), the cleavage domain of StsI endonuclease (SEQ ID NO: 1), StsI-HA (SEQ ID NO: 2), StsI-HA2 (SEQ ID NO: 3), StsI-UHA (SEQ ID NO: 4), StsI-UHA2 (SEQ ID NO: 5), StsI-HF (SEQ ID NO: 6), and StsI-UHF (SEQ ID NO: 7) or a biologically active fragment or variant thereof.

Engineered gene-editing proteins that comprise DNA-binding domains comprising certain novel repeat sequences can exhibit lower off-target activity in vivo than previously disclosed gene-editing proteins, while maintaining a high level of on-target activity in vivo. Certain of these engineered gene-editing proteins can provide several advantages over previously disclosed gene-editing proteins, including, for example, increased flexibility of the linker region connecting repeat sequences, which can result in increased binding efficiency. Certain embodiments are therefore directed to a protein comprising a plurality of repeat sequences. In one embodiment, at least one of the repeat sequences contains the amino-acid sequence: GabG, where "a" and "b" each represent any amino acid. In one embodiment, the protein is a gene-editing protein. In another embodiment, one or more of the repeat sequences are present in a DNA-binding domain. In a further embodiment, "a" and "b" are each independently selected from the group: H and G. In a still further embodiment, "a" and "b" are H and G, respectively. In one embodiment, the amino-acid sequence is present within about 5 amino acids of the C-terminus of the repeat sequence. In another embodiment, the amino-acid sequence is present at the C-terminus of the repeat sequence. In embodiments, one or more G in the amino-acid sequence GabG is replaced with one or more amino acids other than G, for example A, H or GG. In one embodiment, the repeat sequence has a length of between about 32 and about 40 amino acids or between about 33 and about 39 amino acids or between about 34 and 38 amino acids or between about 35 and about 37 amino acids or about 36 amino acids or greater than about 32 amino acids or greater than about 33 amino acids or greater than about 34 amino acids or greater than about 35 amino acids. Other embodiments are directed to a protein comprising one or more transcription activator-like effector domains. In one embodiment, at least one of the transcription activator-like effector domains comprises a repeat sequence. Other embodiments are directed to a protein comprising a plurality of repeat sequences generated by inserting one or more amino acids between at least two of the repeat sequences of a transcription activator-like effector domain. In one embodiment, one or more amino acids is inserted about 1 or about 2 or about 3 or about 4 or about 5 amino acids from the C-terminus of at least one repeat sequence. Still other embodiments are directed to a protein comprising a plurality of repeat sequences, wherein about every other repeat sequence has a different length than the repeat sequence immediately preceding or following the repeat sequence. In one embodiment, every other repeat sequence is about 36 amino acids long. In another embodiment, every other repeat sequence is 36 amino acids long. Still other embodiments are directed to a protein comprising a plurality of repeat sequences, wherein the plurality of repeat sequences comprises at least two repeat sequences that are each at least 36 amino acids long, and wherein at least two of the repeat sequences that are at least 36 amino acids long are separated by at least one repeat sequence that is less than 36 amino acids long. Some embodiments are directed to a protein that comprises one or more sequences selected from, for example, SEQ ID NO: 54, SEQ ID NO: 55, SEQ ID NO: 56, SEQ ID NO: 57, SEQ ID NO: 58, SEQ ID NO: 59, and SEQ ID NO: 60.

Other embodiments are directed to a protein that comprises a DNA-binding domain. In embodiments, the DNA-binding domain comprises a plurality of repeat sequences. In one embodiment, the plurality of repeat sequences enables high-specificity recognition of a binding site in a target DNA molecule. In another embodiment, at least two of the repeat sequences have at least about 50%, or about 60%, or about 70%, or about 80%, or about 90%, or about 95%, or about 98%, or about 99% homology to each other. In a further embodiment, at least one of the repeat sequences comprises one or more regions capable of binding to a binding site in a target DNA molecule. In a still further embodiment, the binding site comprises a defined sequence of between about 1 to about 5 bases in length. In one embodiment, the DNA-binding domain comprises a zinc finger. In another embodiment, the DNA-binding domain comprises a transcription activator-like effector (TALE). In a further embodiment, the plurality of repeat sequences includes at least one repeat sequence having at least about 50% or about 60% or about 70% or about 80% or about 90% or about 95% or about 98%, or about 99% homology to a TALE. In a still further embodiment, the gene-editing protein comprises a clustered regularly interspaced short palindromic repeat (CRISPR)-associated protein. In one embodiment, the gene-editing protein comprises a nuclear-localization sequence. In another embodiment, the nuclear-localization sequence comprises the amino-acid sequence: PKKKRKV (SEQ ID NO: 471). In one embodiment, the gene-editing protein comprises a mitochondrial-localization sequence. In another embodiment, the mitochondrial-localization sequence comprises the amino-acid sequence: LGRVIPRKIASRASLM (SEQ ID NO: 472). In one embodiment, the gene-editing protein comprises a linker. In another embodiment, the linker connects a DNA-binding domain to a nuclease domain. In a further embodiment, the linker is between about 1 and about 10 amino acids long. In embodiments, the linker is about 1, about 2, or about 3, or about 4, or about 5, or about 6, or about 7, or about 8, or about 9, or about 10 amino acids long. In one embodiment, the gene-editing protein is capable of generating a nick or a double-strand break in a target DNA molecule.

In embodiments, gene-editing protein comprises: (a) a DNA-binding domain comprising a plurality of repeat sequences and at least one of the repeat sequences comprises the amino acid sequence: LTPvQVVAIAwxyzGHGG (SEQ ID NO: 629), where "v" is Q, D or E, "w" is S or N, "x" is H, N, or I, "y" is D, A, I, N, G, H, K, S, or null, and "z" is GGKQALETVQRLLPVLCQD (SEQ ID NO: 630) or GGKQALETVQRLLPVLCQA (SEQ ID NO: 631); and, optionally, (b) a nuclease domain comprising a catalytic domain of a nuclease. In embodiments, the nuclease domain is capable of forming a dimer with another nuclease domain. In embodiments, the nuclease domain comprises the catalytic domain of a protein comprising the amino acid sequence of SEQ ID NO: 632. In embodiments, at least one of the repeat sequences comprising the amino acid sequence LTPvQVVAIAwxyzGHGG (SEQ ID NO: 629) is between 36 and 39 amino acids long.

Certain embodiments are directed to a method for modifying the genome of a cell in vivo, the method comprising introducing into a cell in vivo a nucleic acid molecule encoding a non-naturally occurring fusion protein comprising an artificial transcription activator-like (TAL) effector repeat domain comprising one or more repeat units 36 amino acids in length and an endonuclease domain, wherein the repeat domain is engineered for recognition of a predetermined nucleotide sequence, and wherein the fusion protein recognizes the predetermined nucleotide sequence. In one embodiment, the cell is a eukaryotic cell. In another embodiment, the cell is an animal cell. In a further embodiment, the cell is a mammalian cell. In a still further embodiment, the cell is a human cell. In one embodiment, the cell is a plant cell. In another embodiment, the cell is a prokaryotic cell. In embodiments, the fusion protein introduces an endonucleolytic cleavage in a nucleic acid of the cell, whereby the genome of the cell is modified.

Certain embodiments are directed to a composition for altering the DNA sequence of a cell in vivo comprising a nucleic acid, wherein the nucleic acid encodes a gene-editing protein. Other embodiments are directed to a composition for altering the DNA sequence of a cell in vivo comprising a nucleic-acid mixture, wherein the nucleic-acid mixture comprises: a first nucleic acid that encodes a first gene-editing protein, and a second nucleic acid that encodes a second gene-editing protein. In one embodiment, the binding site of the first gene-editing protein and the binding site of the second gene-editing protein are present in the same target DNA molecule. In another embodiment, the binding site of the first gene-editing protein and the binding site of the second gene-editing protein are separated by less than about 50 bases, or less than about 40 bases, or less than about 30 bases or less than about 20 bases, or less than about 10 bases, or between about 10 bases and about 25 bases or about 15 bases. In one embodiment, the nuclease domain of the first gene-editing protein and the nuclease domain of the second gene-editing protein are capable of forming a dimer. In another embodiment, the dimer is capable of generating a nick or double-strand break in a target DNA molecule.

Certain embodiments are directed to a therapeutic composition. Other embodiments are directed to a cosmetic composition. In embodiments, the composition comprises a repair template. In a further embodiment, the repair template is a single-stranded DNA molecule or a double-stranded DNA molecule.

Other embodiments are directed to an article of manufacture for synthesizing a protein or a nucleic acid encoding a protein. In one embodiment, the article is a nucleic acid. In another embodiment, the protein comprises a DNA-binding domain. In a further embodiment, the nucleic acid comprises a nucleotide sequence encoding a DNA-binding domain. In one embodiment, the protein comprises a nuclease domain. In another embodiment, the nucleic acid comprises a nucleotide sequence encoding a nuclease domain. In one embodiment, the protein comprises a plurality of repeat sequences. In another embodiment, the nucleic acid encodes a plurality of repeat sequences. In a further embodiment, the nuclease domain is selected from FokI, StsI, StsI-HA, StsI-HA2, StsI-UHA, StsI-UHA2, StsI-HF, and StsI-UHF or a natural or engineered variant or biologically active fragment thereof. In one embodiment, the nucleic acid comprises an RNA-polymerase promoter. In another embodiment, the RNA-polymerase promoter is a T7 promoter or a SP6 promoter. In a further embodiment, the nucleic acid comprises a viral promoter. In one embodiment, the nucleic acid comprises an untranslated region. In another embodiment, the nucleic acid is an in vitro-transcription template.

Certain embodiments are directed to a method for inducing a cell to express a protein in vivo. Other embodiments are directed to a method for altering the DNA sequence of a cell in vivo comprising transfecting the cell in vivo with a gene-editing protein or inducing the cell to express a gene-editing protein in vivo. Still other embodiments are directed to a method for reducing the expression of a protein of interest in a cell in vivo. In one embodiment, the cell is induced to express a gene-editing protein, wherein the gene-editing protein is capable of creating a nick or a double-strand break in a target DNA molecule. In another embodiment, the nick or double-strand break results in inactivation of a gene. Still other embodiments are directed to a method for generating an inactive, reduced-activity or dominant-negative form of a protein in vivo. In one embodiment, the protein is survivin. Still other embodiments are directed to a method for repairing one or more mutations in a cell in vivo. In one embodiment, the cell is contacted with a repair template. In another embodiment, the repair template is a DNA molecule. In a further embodiment, the repair template does not contain a binding site of the gene-editing protein. In a still further embodiment, the repair template encodes an amino-acid sequence that is encoded by a DNA sequence that comprises a binding site of the gene-editing protein.

In various embodiments, the repair template is about 20 nucleotides, or about 30 nucleotides, or about 40 nucleotides, or about 50 nucleotides, or about 60 nucleotides, or about 70 nucleotides, or about 80 nucleotides, or about 90 nucleotides, or about 100 nucleotides, or about 150 nucleotides, or about 200 nucleotides, or about 300 nucleotides, or about 400 nucleotides, or about 500 nucleotides, or about 750 nucleotides, or about 1000 nucleotides. In various embodiments, the repair template is about 20-1000 nucleotides, or about 20-500 nucleotides, or about 20-400 nucleotides, or about 20-200 nucleotides, or about 20-100 nucleotides, or about 80-100 nucleotides, or about 50-100 nucleotides.

In various embodiments, the mass ratio of RNA (e.g. synthetic RNA encoding gene-editing protein) to repair template is about 1:10, or about 1:9, or about 1:8, or about 1:7, or about 1:6, or about 1:5, or about 1:4, or about 1:3, or about 1:2, or about 1:1, or about 2:1, or about 3:1, or about 4:1, or about 5:1, or about 6:1, or about 7:1, or about 8:1, or about 9:1, or about 10:1.

In various embodiments, the molar ratio of RNA (e.g. synthetic RNA encoding gene-editing protein) to repair template is about 1:10, or about 1:9, or about 1:8, or about 1:7, or about 1:6, or about 1:5, or about 1:4, or about 1:3, or about 1:2, or about 1:1, or about 2:1, or about 3:1, or about 4:1, or about 5:1, or about 6:1, or about 7:1, or about 8:1, or about 9:1, or about 10:1.

In various embodiments, the repair template has a dual function, causing a repair to a gene-edited target sequence and preventing further binding of a gene-editing protein, thereby reducing or eliminating further gene-editing (e.g. via the repair template causing a repair that renders what was the gene-editing protein binding site no longer suitable for gene-editing protein binding). Accordingly, in some embodiments, the present gene-editing methods are tunable to ensure a single gene-edit per target site.

Reprogramming

In aspects, the present invention relates to a method for reprogramming a differentiated cell to a less differentiated state, comprising (a) providing a differentiated or non-pluripotent cell; (b) culturing the differentiated cell or non-pluripotent; and (c) transfecting the differentiated cell or non-pluripotent with a complex of one or more synthetic RNA molecules and a compound described herein (e.g. of Formulae I-XVI), where the one or more synthetic RNA molecules include at least one RNA molecule encoding one or more reprogramming factors and where the transfecting results in the cell expressing the one or more reprogramming factors, to result in the cell being reprogrammed to a less differentiated state. In embodiments, step (c) occurs in the presence of a medium containing ingredients that support reprogramming of the differentiated cell to a less differentiated state. In embodiments, the further comprises repeating step (c) at least twice during 5 consecutive days. In embodiments, the amount of one or more synthetic RNA molecules transfected in one or more later transfections is greater than the amount transfected in one or more earlier transfections. In embodiments, steps (a)-(c) are performed without using feeder cells and occur in the presence of a feeder cell conditioned medium. In embodiments, step (c) is performed without using irradiated human neonatal fibroblast feeder cells and occurs in the presence of a feeder cell conditioned medium. In embodiments, the synthetic RNA molecule encodes one or more reprogramming factor(s) selected from Oct4, Sox2, Klf4, c-Myc, I-Myc, Tert, Nanog, Lin28, Utf1, Aicda, miR200 micro-RNA, miR302 micro-RNA, miR367 micro-RNA, miR369 micro-RNA and biologically active fragments, analogues, variants and family-members thereof.

In embodiments, the differentiated or non-pluripotent cell is derived from a biopsy. In embodiments, the differentiated or non-pluripotent cell is from a human subject. In embodiments, the differentiated or non-pluripotent cell is derived from a dermal punch biopsy sample. In embodiments, differentiated or non-pluripotent cell is a keratinocyte, fibroblast, or PBMC.

In embodiments, the method for reprogramming further comprising contacting the cell with at least one member of the group: poly-L-lysine, poly-L-ornithine, RGD peptide, fibronectin, vitronectin, collagen, and laminin.

In embodiments, the method for reprogramming uses a medium which is substantially free of immunosuppressants.

Cells can be reprogrammed by exposing them to specific extracellular cues and/or by ectopic expression of specific proteins, microRNAs, etc. While several reprogramming methods have been previously described, most that rely on ectopic expression require the introduction of exogenous DNA, which can carry mutation risks. DNA-free reprogramming methods based on direct delivery of reprogramming proteins have been reported. However, these methods are too inefficient and unreliable for commercial use. In addition, RNA-based reprogramming methods have been described (see, e.g., Angel. MIT Thesis. 2008. 1-56; Angel et al. PLoS ONE. 2010. 5,107; Warren et al. Cell Stem Cell. 2010. 7,618-630; Angel. MIT Thesis. 2011. 1-89; and Lee et al., Cell. 2012. 151,547-558; the contents of all of which are hereby incorporated by reference). However, existing RNA-based reprogramming methods are slow, unreliable, and inefficient when performed on adult cells, require many transfections (resulting in significant expense and opportunity for error), can reprogram only a limited number of cell types, can reprogram cells to only a limited number of cell types, require the use of immunosuppressants, and require the use of multiple human-derived components, including blood-derived HSA and human fibroblast feeders. The many drawbacks of previously disclosed RNA-based reprogramming methods make them undesirable for research, therapeutic or cosmetic use.

Reprogramming can be performed by transfecting cells with one or more nucleic acids encoding one or more reprogramming factors. Examples of reprogramming factors include, but are not limited to Oct4 protein, Sox2 protein, Klf4 protein, c-Myc protein, I-Myc protein, TERT protein, Nanog protein, Lin28 protein, Utf1 protein, Aicda protein, miR200 micro-RNA, miR302 micro-RNA, miR367 micro-RNA, miR369 micro-RNA and biologically active fragments, analogues, variants and family-members thereof. Certain embodiments are therefore directed to a method for reprogramming a cell in vivo. In one embodiment, the cell in vivo is reprogrammed by transfecting the cell with one or more nucleic acids encoding one or more reprogramming factors. In one embodiment, the one or more nucleic acids includes an RNA molecule that encodes Oct4 protein. In another embodiment, the one or more nucleic acids also includes one or more RNA molecules that encodes Sox2 protein, Klf4 protein, and c-Myc protein. In yet another embodiment, the one or more nucleic acids also includes an RNA molecule that encodes Lin28 protein. In one embodiment, the cell is a human skin cell, and the human skin cell is reprogrammed to a pluripotent stem cell. In another embodiment, the cell is a human skin cell, and the human skin cell is reprogrammed to a glucose-responsive insulin-producing cell. Examples of other cells that can be reprogrammed and other cells to which a cell can be reprogrammed include, but are not limited to skin cells, pluripotent stem cells, mesenchymal stem cells, β-cells, retinal pigmented epithelial cells, hematopoietic cells, cardiac cells, airway epithelial cells, neural stem cells, neurons, glial cells, bone cells, blood cells, and dental pulp stem cells. In one embodiment, the cell is contacted with a medium that supports the reprogrammed cell. In one embodiment, the medium also supports the cell.

Importantly, infecting skin cells with viruses encoding Oct4, Sox2, Klf4, and c-Myc, combined with culturing the cells in a medium that supports the growth of cardiomyocytes, has been reported to cause reprogramming of the skin cells to cardiomyocytes, without first reprogramming the skin cells to pluripotent stem cells (See Efs et al., *Nat Cell Biol.* 2011; 13:215-22, the contents of which are hereby incorporated by reference). In certain situations, direct reprogramming (reprogramming one somatic cell to another somatic cell without first reprogramming the somatic cell to a pluripotent stem cell, also known as "transdifferentiation") may be desirable, in part because culturing pluripotent stem cells can be time-consuming and expensive, the additional handling involved in establishing and characterizing a stable pluripotent stem cell line can carry an increased risk of contamination, and the additional time in culture associated with first producing pluripotent stem cells can carry an increased risk of genomic instability and the acquisition of mutations, including point mutations, copy-number variations, and karyotypic abnormalities. Certain embodiments are therefore directed to a method for reprogramming a somatic cell in vivo, wherein the cell is reprogrammed to a somatic cell, and wherein a characterized pluripotent stem-cell line is not produced.

In certain situations, fewer total transfections may be required to reprogram a cell according to the methods of the present invention than according to other methods. Certain embodiments are therefore directed to a method for reprogramming a cell in vivo, wherein between about 1 and about 12 transfections are performed during about 20 consecutive days, or between about 4 and about 10 transfections are performed during about 15 consecutive days, or between about 4 and about 8 transfections are performed during about 10 consecutive days. It is recognized that when a cell is contacted with a medium containing nucleic acid molecules, the cell may likely come into contact with and/or internalize more than one nucleic acid molecule either simultaneously or at different times. A cell can therefore be contacted with a nucleic acid more than once, e.g. repeatedly, even when a cell is contacted only once with a medium containing nucleic acids.

Of note, nucleic acids can contain one or more non-canonical or "modified" residues as described herein. For instance, any of the non-canonical nucleotides described herein can be used in the present reprogramming methods. In one embodiment, pseudouridine-5'-triphosphate can be substituted for uridine-5'-triphosphate in an in vitro-transcription reaction to yield synthetic RNA, wherein up to 100% of the uridine residues of the synthetic RNA may be replaced with pseudouridine residues. In vitro-transcription can yield RNA with residual immunogenicity, even when pseudouridine and 5-methylcytidine are completely substituted for uridine and cytidine, respectively (see, e.g., Angel. Reprogramming Human Somatic Cells to Pluripotency Using RNA [Doctoral Thesis]. Cambridge, MA: MIT; 2011, the contents of which are hereby incorporated by reference). For this reason, it is common to add an immunosuppressant to the transfection medium when transfecting cells with RNA. In certain situations, adding an immunosuppressant to the transfection medium may not be desirable, in part because the recombinant immunosuppressant most commonly used for this purpose, B18R, can be expensive and difficult to manufacture.

Cells, in vivo can be transfected and/or reprogrammed according to the methods of the present invention, without using B18R or any other immunosuppressant. Reprogramming cells in vivo according to the methods of the present invention without using immunosuppressants can be rapid, efficient, and reliable. Certain embodiments are therefore directed to a method for transfecting a cell in vivo, wherein the transfection medium does not contain an immunosuppressant. Other embodiments are directed to a method for reprogramming a cell in vivo, wherein the transfection medium does not contain an immunosuppressant. In certain situations, for example when using a high cell density, it may be beneficial to add an immunosuppressant to the transfection medium. Certain embodiments are therefore directed to a method for transfecting a cell in vivo, wherein the transfection medium contains an immunosuppressant. Other embodiments are directed to a method for reprogramming a cell in vivo, wherein the transfection medium contains an immunosuppressant. In one embodiment, the immunosuppressant is B18R or a biologically active fragment, analogue, variant or family-member thereof or dexamethasone or a derivative thereof. In one embodiment, the transfection medium does not contain an immunosuppressant, and the nucleic-acid dose is chosen to prevent excessive toxicity. In another embodiment, the nucleic-acid dose is less than about 1 mg/cm$^2$ of tissue or less than about 1 mg/100,000 cells or less than about 10 mg/kg.

Reprogrammed cells produced according to certain embodiments of the present invention are suitable for therapeutic and/or cosmetic applications as they do not contain undesirable exogenous DNA sequences, and they are not exposed to animal-derived or human-derived products, which may be undefined, and which may contain toxic and/or pathogenic contaminants. Furthermore, the high speed, efficiency, and reliability of certain embodiments of the present invention may reduce the risk of acquisition and accumulation of mutations and other chromosomal abnormalities. Certain embodiments of the present invention can thus be used to generate cells that have a safety profile adequate for use in therapeutic and/or cosmetic applications. For example, reprogramming cells using RNA and the medium of the present invention, wherein the medium does not contain animal or human-derived components, can yield cells that have not been exposed to allogeneic material. Certain embodiments are therefore directed to a reprogrammed cell that has a desirable safety profile. In one embodiment, the reprogrammed cell has a normal karyotype. In another embodiment, the reprogrammed cell has fewer than about 5 copy-number variations (CNVs) relative to the patient genome, such as fewer than about 3 copy-number variations relative to the patient genome, or no copy-number variations relative to the patient genome. In yet another embodiment, the reprogrammed cell has a normal karyotype and fewer than about 100 single nucleotide variants in coding regions relative to the patient genome, or fewer than about 50 single nucleotide variants in coding regions relative to the patient genome, or fewer than about 10 single nucleotide variants in coding regions relative to the patient genome.

Endotoxins and nucleases can co-purify and/or become associated with other proteins, such as serum albumin. Recombinant proteins, in particular, can often have high levels of associated endotoxins and nucleases, due in part to the lysis of cells that can take place during their production. Endotoxins and nucleases can be reduced, removed, replaced or otherwise inactivated by many of the methods of the present invention, including, for example, by acetylation, by addition of a stabilizer such as sodium octanoate, followed by heat treatment, by the addition of nuclease inhibitors to the albumin solution and/or medium, by crystallization, by contacting with one or more ion-exchange resins, by contacting with charcoal, by preparative electrophoresis or by affinity chromatography. Partially or completely reducing, removing, replacing, or otherwise inactivating endotoxins and/or nucleases from a medium and/or from one or more components of a medium can increase the efficiency with which cells can be transfected and reprogrammed. Certain embodiments are therefore directed to a method for transfecting a cell in vivo with one or more nucleic acids, wherein the transfection medium is treated to partially or completely reduce, remove, replace or otherwise inactivate one or more endotoxins and/or nucleases. Other embodiments are directed to a medium that causes minimal degradation of nucleic acids. In one embodiment, the medium contains less than about 1 EU/mL, or less than about 0.1 EU/mL, or less than about 0.01 EU/mL.

In certain situations, protein-based lipid carriers such as serum albumin can be replaced with non-protein-based lipid carriers such as methyl-beta-cyclodextrin. The medium of the present invention can also be used without a lipid carrier, for example, when transfection is performed using a method that may not require or may not benefit from the presence of a lipid carrier, for example, using one or more lipid-based transfection reagents, polymer-based transfection reagents or peptide-based transfection reagents or using electroporation. Many protein-associated molecules, such as metals, can be highly toxic to cells in vivo. This toxicity can cause decreased viability, as well as the acquisition of mutations. Certain embodiments thus have the additional benefit of producing cells that are free from toxic molecules.

The associated-molecule component of a protein can be measured by suspending the protein in solution and measuring the conductivity of the solution. Certain embodiments are therefore directed to a medium that contains a protein, wherein about a 10% solution of the protein in water has a conductivity of less than about 500 μmho/cm. In one embodiment, the solution has a conductivity of less than about 50 μmho/cm. In another embodiment, less than about 0.65% of the dry weight of the protein comprises lipids and/or less than about 0.35% of the dry weight of the protein comprises free fatty acids.

The amount of nucleic acid delivered to cells in vivo can be increased to increase the desired effect of the nucleic acid. However, increasing the amount of nucleic acid delivered to cells in vivo beyond a certain point can cause a decrease in the viability of the cells, due in part to toxicity of the transfection reagent. When a nucleic acid is delivered to a population of cells in vivo in a fixed volume (for example, cells in a region of tissue), the amount of nucleic acid delivered to each cell can depend on the total amount of nucleic acid delivered to the population of cells and to the density of the cells, with a higher cell density resulting in less nucleic acid being delivered to each cell. In certain embodiments, a cell in vivo is transfected with one or more nucleic acids more than once. Under certain conditions, for example when the cells are proliferating, the cell density may change from one transfection to the next. Certain embodiments are therefore directed to a method for transfecting a cell in vivo with a nucleic acid, wherein the cell is transfected more than once, and wherein the amount of nucleic acid delivered to the cell is different for two of the transfections. In one embodiment, the cell proliferates between two of the transfections, and the amount of nucleic acid delivered to the cell is greater for the second of the two transfections than for the first of the two transfections. In another embodiment, the cell is transfected more than twice, and the amount of nucleic acid delivered to the cell is greater for the second of three transfections than for the first of the same three transfections, and the amount of nucleic acid delivered to the cells is greater for the third of the same three transfections than for the second of the same three transfections. In yet another embodiment, the cell is transfected more than once, and the maximum amount of nucleic acid delivered to the cell during each transfection is sufficiently low to yield at least about 80% viability for at least two consecutive transfections.

Modulating the amount of nucleic acid delivered to a population of proliferating cells in vivo in a series of transfections can result in both an increased effect of the nucleic acid and increased viability of the cells. In certain situations, when cells in vivo are contacted with one or more nucleic acids encoding one or more reprogramming factors in a series of transfections, the efficiency of reprogramming can be increased when the amount of nucleic acid delivered in later transfections is greater than the amount of nucleic acid delivered in earlier transfections, for at least part of the series of transfections. Certain embodiments are therefore directed to a method for reprogramming a cell in vivo, wherein one or more nucleic acids is repeatedly delivered to the cell in a series of transfections, and the amount of the nucleic acid delivered to the cell is greater for at least one later transfection than for at least one earlier transfection. In one embodiment, the cell is transfected between about 2 and about 10 times, or between about 3 and about 8 times, or between about 4 and about 6 times. In another embodiment, the one or more nucleic acids includes at least one RNA molecule, the cell is transfected between about 2 and about 10 times, and the amount of nucleic acid delivered to the cell in each transfection is the same as or greater than the amount of nucleic acid delivered to the cell in the most recent previous transfection. In yet another embodiment, the amount of nucleic acid delivered to the cell in the first transfection is between about 20 $ng/cm^2$ and about 250 $ng/cm^2$, or between 100 $ng/cm^2$ and 600 $ng/cm^2$. In yet another embodiment, the cell is transfected about 5 times at intervals of between about 12 and about 48 hours, and the amount of nucleic acid delivered to the cell is about 25 $ng/cm^2$ for the first transfection, about 50 $ng/cm^2$ for the second transfection, about 100 $ng/cm^2$ for the third transfection, about 200 $ng/cm^2$ for the fourth transfection, and about 400 $ng/cm^2$ for the fifth transfection. In yet another embodiment, the cell is further transfected at least once after the fifth transfection, and the amount of nucleic acid delivered to the cell is about 400 $ng/cm^2$.

Certain embodiments are directed to a method for transfecting a cell in vivo with a nucleic acid, wherein the amount of nucleic acid is determined by measuring the cell density, and choosing the amount of nucleic acid to transfect based on the measurement of cell density. In one embodiment, the cell density is measured by optical means. In another embodiment, the cell is transfected repeatedly, the cell density increases between two transfections, and the amount of nucleic acid transfected is greater for the second of the two transfections than for the first of the two transfections.

The amount of a circulating protein that is produced in a patient can be increased by administering to a patient a nucleic acid at a plurality of administration sites. In certain embodiments, the amount of a circulating protein is increased relative to the amount of the circulating protein that is produced in a patient by administering to the patient the nucleic acid at a single injection site. In one embodiment, the administering is by injection. In another embodiment, the injection is intradermal injection. In still another embodiment, the injection is subcutaneous or intramuscular injection. In embodiments, the plurality of administration sites comprises administration sites in the skin. In other embodiments, the plurality of administration sites is at least about 1 or at least about 2 or at least about 5 or at least about 10 or at least about 20 or at least about 50 or at least about 100 administration sites. In one embodiment, the administering is performed within at least about 5 minutes or at least about 10 minutes or at least about 30 minutes or at least about 1 hour or at least about 2 hours or at least about 5 hours or at least about 12 hours or at least about 1 day. In certain embodiments, the amount of a circulating protein is increased by at least about 10 percent or at least about 20 percent or at least about 50 percent or at least about 100 percent or at least about 3-fold or at least about 5-fold or at least about 10-fold or at least about 20-fold or at least about 50-fold or at least about 100-fold or at least about 500-fold or at least about 1000-fold or greater than 1000-fold.

In certain situations, the in vivo transfection efficiency and viability of cells contacted with the medium of the present invention can be improved by conditioning the medium. Certain embodiments are therefore directed to a method for conditioning a medium. Other embodiments are directed to a medium that is conditioned. In one embodiment, the feeders are fibroblasts, and the medium is conditioned for approximately 24 hours. Other embodiments are directed to a method for transfecting a cell in vivo, wherein the transfection medium is conditioned. Other embodiments are directed to a method for reprogramming and/or gene-editing a cell in vivo, wherein the medium is conditioned. In one embodiment, the feeders are mitotically inactivated, for example, by exposure to a chemical such as mitomycin-C or by exposure to gamma radiation. In certain embodiments, it may be beneficial to use only autologous materials, in part to, for example and not wishing to be bound by theory, avoid the risk of disease transmission from the feeders to the cell or the patient. Certain embodiments are therefore directed to a method for transfecting a cell in vivo, wherein the transfection medium is conditioned, and wherein the feeders are derived from the same individual as the cell being transfected. Other embodiments are directed to a method for reprogramming and/or gene-editing a cell in vivo, wherein the medium is conditioned, and wherein the feeders are derived from the same individual as the cell being reprogrammed and/or gene-edited.

Several molecules can be added to media by conditioning. Certain embodiments are therefore directed to a medium that is supplemented with one or more molecules that are present in a conditioned medium. In one embodiment, the medium is supplemented with Wnt1, Wnt2, Wnt3, Wnt3a or a biologically active fragment, analogue, variant, agonist, or family-member thereof. In another embodiment, the medium is supplemented with TGF-β or a biologically active fragment, analogue, variant, agonist, or family-member thereof. In yet another embodiment, a cell in vivo is reprogrammed according to the method of the present invention, wherein the medium is not supplemented with TGF-β for between about 1 and about 5 days, and is then supplemented with TGF-β for at least about 2 days. In yet another embodiment, the medium is supplemented with IL-6, IL-6R or a biologically active fragment, analogue, variant, agonist, or family-member thereof. In yet another embodiment, the medium is supplemented with a sphingolipid or a fatty acid. In still another embodiment, the sphingolipid is lysophosphatidic acid, lysosphingomyelin, sphingosine-1-phosphate or a biologically active analogue, variant or derivative thereof.

In addition to mitotically inactivating cells, under certain conditions, irradiation can change the gene expression of cells, causing cells to produce less of certain proteins and more of certain other proteins that non-irradiated cells, for example, members of the Wnt family of proteins. In addition, certain members of the Wnt family of proteins can promote the growth and transformation of cells. In certain situations, the efficiency of reprogramming can be greatly increased by contacting a cell in vivo with a medium that is conditioned using irradiated feeders instead of mitomycin-c-treated feeders. The increase in reprogramming efficiency observed when using irradiated feeders is caused in part by Wnt proteins that are secreted by the feeders. Certain embodiments are therefore directed to a method for reprogramming a cell in vivo, wherein the cell is contacted with Wnt1, Wnt2, Wnt3, Wnt3a or a biologically active fragment, analogue, variant, family-member or agonist thereof, including agonists of downstream targets of Wnt proteins, and/or agents that mimic one or more of the biological effects of Wnt proteins, for example, 2-amino-4-[3,4-(methylenedioxy)benzylamino]-6-(3-methoxyphenyl)pyrimidine.

Because of the low efficiency of many DNA-based reprogramming methods, these methods may be difficult or impossible to use with cells derived from patient samples, which may contain only a small number of cells. In contrast, the high efficiency of certain embodiments of the present invention can allow reliable reprogramming of a small number of cells, including single cells. Certain embodiments are directed to a method for reprogramming a small number of cells. Other embodiments are directed to a method for reprogramming a single cell. In one embodiment, the cell is contacted with one or more enzymes. In another embodiment, the enzyme is collagenase.

In yet another embodiment, the collagenase is animal-component free. In one embodiment, the collagenase is present at a concentration of between about 0.1 mg/mL and about 10 mg/mL, or between about 0.5 mg/mL and about 5 mg/mL. In another embodiment, the cell is a blood cell. In yet another embodiment, the cell is contacted with a medium containing one or more proteins that is derived from the patient's blood. In still another embodiment, the cell is contacted with a medium comprising: DMEM/F12+2 mM L-alanyl-L-glutamine+between about 5% and about 25% patient-derived serum, or between about 10% and about 20% patient-derived serum, or about 20% patient-derived serum.

In certain situations, transfecting cells in vivo with a mixture of RNA encoding Oct4, Sox2, Klf4, and c-Myc using the medium of the present invention can cause the rate of proliferation of the cells to increase. When the amount of RNA delivered to the cells is too low to ensure that all of the cells are transfected, only a fraction of the cells may show an increased proliferation rate. In certain situations, such as when generating a personalized therapeutic, increasing the proliferation rate of cells may be desirable, in part because doing so can reduce the time necessary to generate therapeutic, and therefore can reduce the cost of therapeutic. Certain embodiments are therefore directed to a method for transfecting a cell in vivo with a mixture of RNA encoding Oct4, Sox2, Klf4, and c-Myc. In one embodiment, the cell exhibits an increased proliferation rate. In another embodiment, the cell is reprogrammed.

Methods for simultaneous or sequential gene editing and reprogramming of somatic cells as described herein, are also provided.

Methods of Treatment

In embodiments, the present invention relates to method of treatment of a disease or disorder by delivering a therapeutic agent with the present compounds (e.g. of Formulae I-XVI) and/or pharmaceutical compositions and/or lipid aggregates and/or lipid carriers.

In embodiments, the present invention relates to method of treatment of a disease or disorder by delivering a nucleic acid therapeutic agent with the present compounds (e.g. of Formulae I-XVI) and/or pharmaceutical compositions and/or lipid aggregates and/or lipid carriers.

In embodiments, the present invention relates to method of treatment of a disease or disorder by delivering an RNA, e.g. synthetic RNA, therapeutic agent with the present compounds (e.g. of Formulae I-XVI) and/or pharmaceutical compositions and/or lipid aggregates and/or lipid carriers.

In embodiments, the present invention relates to method of treatment of a disease or disorder by delivering a therapeutic agent, e.g. nucleic acid, e.g. RNA, e.g. synthetic RNA, therapeutic agent with the present compounds (e.g. of Formulae I-XVI) and/or pharmaceutical compositions and/or lipid aggregates and/or lipid carriers in a method of expressing a protein of interest that has a therapeutic effect.

In embodiments, the present invention relates to method of treatment of a disease or disorder by delivering a therapeutic agent, e.g. nucleic acid, e.g. RNA, e.g. synthetic RNA, therapeutic agent with the present compounds (e.g. of Formulae I-XVI) and/or pharmaceutical compositions and/or lipid aggregates and/or lipid carriers in a method of expressing a gene-editing protein that has a therapeutic effect (e.g. gene-editing or gene correction, e.g. in vivo and/or ex vivo).

In embodiments, the present invention relates to method of treatment of a disease or disorder by delivering a therapeutic agent, e.g. nucleic acid, e.g. RNA, e.g. synthetic RNA, therapeutic agent with the present compounds (e.g. of Formulae I-XVI) and/or pharmaceutical compositions and/or lipid aggregates and/or lipid carriers in a method of expressing a reprogramming factor that has a therapeutic effect (e.g. ex vivo).

In embodiments, the present invention relates to method of treatment of a disease or disorder by delivering a therapeutic agent, e.g. nucleic acid, e.g. RNA, e.g. synthetic RNA, therapeutic agent with the present compounds (e.g. of Formulae I-XVI) and/or pharmaceutical compositions and/or lipid aggregates and/or lipid carriers in a method of expressing a gene-editing protein that has a therapeutic effect (e.g. gene-editing or gene correction, e.g. in vivo and/or ex vivo) and expressing a reprogramming factor that has a therapeutic effect (e.g. ex vivo).

Certain embodiments are directed to a method for treating a patient comprising: a. inducing a cell to express a protein of interest by transfecting the cell in vivo with a nucleic acid encoding the protein of interest and/or b. reprogramming the cell in vivo. In one embodiment, the cell is reprogrammed to a less differentiated state. In another embodiment, the cell is reprogrammed by transfecting the cell with one or more synthetic RNA molecules encoding one or more reprogramming proteins. In a further embodiment, the cell is differentiated. In a still further embodiment, the cell is differentiated into one of a skin cell, a glucose-responsive insulin-producing cell, a hematopoietic cell, a cardiac cell, a retinal cell, a renal cell, a neural cell, a stromal cell, a fat cell, a bone cell, a muscle cell, an oocyte, and a sperm cell. Other embodiments are directed to a method for treating a patient comprising: a. inducing a cell to express a gene-editing protein by transfecting the cell in vivo with a nucleic acid encoding a gene-editing protein and/or b. reprogramming the cell in vivo.

In embodiments, the treatment results in one or more of the patient's symptoms being ameliorated.

Certain embodiments are directed to methods and compositions for the treatment of rare diseases. In embodiments, the rare disease is one or more of a rare metabolic disease, a rare cardiovascular disease, a rare dermatologic disease, a rare neurologic disease, a rare developmental disease, a rare genetic disease, a rare pulmonary disease, a rare liver disease, a rare kidney disease, a rare psychiatric disease, a rare reproductive disease, a rare musculoskeletal disease, a rare orthopedic disease, an inborn error of metabolism, a lysosomal storage disease, and a rare ophthalmologic disease.

Examples of diseases that can be treated with the present invention include, but are not limited to Alzheimer's disease, spinal cord injury, amyotrophic lateral sclerosis, cystic fibrosis, heart disease, including ischemic and dilated cardiomyopathy, macular degeneration, Parkinson's disease, Huntington's disease, diabetes, sickle-cell anemia, thalassemia, Fanconi anemia, xeroderma pigmentosum, muscular dystrophy, severe combined immunodeficiency, hereditary sensory neuropathy, cancer, and HIV/AIDS.

Further examples of diseases that can be treated with the present invention include, but are not limited to type 1 diabetes, heart disease, including ischemic and dilated cardiomyopathy, macular degeneration, Parkinson's disease, cystic fibrosis, sickle-cell anemia, thalassemia, Fanconi anemia, severe combined immunodeficiency, hereditary sensory neuropathy, xeroderma pigmentosum, Huntington's disease, muscular dystrophy, amyotrophic lateral sclerosis, Alzheimer's disease, cancer, and infectious diseases including hepatitis and HIV/AIDS.

In embodiments, examples of diseases that can be treated with the present invention include infectious diseases. In some embodiments, the infectious disease is an infection with a pathogen, optionally selected from a bacterium, virus, fungus, or parasite. In some embodiments, the virus is: (a) an influenza virus, optionally selected from Type A, Type B, Type C, and Type D influenza viruses, or (b) a member of the Coronaviridae family, optionally selected from a betacoronavirus, optionally selected from severe acute respiratory syndrome coronavirus 2 (SARS-CoV-2), SARS-CoV, Middle East Respiratory Syndrome-Corona Virus (MERS-CoV), HCoV-HKU1, and HCoV-OC43 or an alphacoronavirus, optionally selected from HCoV-NL63 and HCoV-229E. In some embodiments, the virus is SARS-CoV-2. In some embodiments, the protein of interest, as described elsewhere herein, is an antigen, such as a 2019-nCoV protein, an antigenic fragment thereof, or a nucleic acid encoding the same, optionally selected from spike surface glycoprotein, membrane glycoprotein M, envelope protein E, and nucleocapsid phosphoprotein N. In some embodiments, protein of interest, as described elsewhere herein, is an antigen, such as the S1 or S2 subunit of the spike surface glycoprotein, or an antigenic fragment thereof.

In various embodiments, the subject is afflicted with coronavirus disease 2019 (COVID-19). In additional embodiments, the subject is elderly and/or afflicted with one or more comorbidities, including, but not limited to, hypertension and/or diabetes. A subject afflicted with a coronavirus infection can acquire symptoms including, but not limited to, fever, tiredness, dry cough, aches and pains, shortness of breath and other breathing difficulties, diarrhea, upper respiratory symptoms (e.g. sneezing, runny nose, nasal congestion, cough, sore throat), pneumonia, pneumonia respiratory failure, hepatic and renal insufficiency, acute respiratory distress syndrome (ARDS), and a cytokine imbalance.

In some embodiments, the virus is an influenza virus. In some embodiments, the protein of interest, as described elsewhere herein, is an antigen, such as an influenza viral antigen, optionally selected from hemagglutinin (HA) protein, matrix 2 (M2) protein, and neuraminidase, or an antigenic fragment thereof, or a nucleic acid encoding the same.

In embodiments, the disease or disorder is selected from diphtheria, tetanus, pertussis, influenza, pneumonia, hepatitis A, hepatitis B, polio, yellow fever, Human Papillomavirus (HPV) infection, anthrax, rabies, Japanese Encephalitis, meningitis, measles, mumps, rubella, gastroenteritis, smallpox, typhoid fever, varicella (chickenpox), rotavirus, and shingles. In some embodiments, the present invention relates to the treatment of hepatitis. Illustrative hepatitis that may be treated include, but is not limited to, hepatitis A, hepatitis B, hepatitis C, hepatitis D, hepatitis E, autoimmune hepatitis, alcoholic hepatitis, acute hepatitis, and chronic hepatitis.

In embodiments, the disease or disorder is metabolic disorder. In embodiments, the metabolic disorder is selected from a disorder of carbohydrate metabolism, a disorder of amino acid metabolism, a disorder of the urea cycle, a disorder of fatty acid metabolism, a disorder of porphyrin metabolism, a disorder of lysosomal storage, a disorder of peroxisome biogenesis, and a disorder of purine or pyrimidine metabolism.

In embodiments, the metabolic disorder is a disorder of carbohydrate metabolism and wherein the disease is galactosemia and the defective gene is optionally GALT, GALK1, or GALE; wherein the disease is essential fructosuria and the defective gene is optionally KHK; wherein the disease is Hereditary fructose intolerance and the defective gene is optionally ALDOB; wherein the disease is glycogen storage disease type I and the defective gene is optionally G6PC, SLC37A4, or SLC17A3; wherein the disease is glycogen storage disease type II and the defective gene is optionally GAA; wherein the disease is glycogen storage disease type III and the defective gene is optionally AGL; wherein the disease is glycogen storage disease type IV and the defective gene is optionally GBE1; wherein the disease is glycogen storage disease type V and the defective gene is optionally PYGM; wherein the disease is glycogen storage disease type VI and the defective gene is optionally PYGL; wherein the disease is glycogen storage disease type VII and the defective gene is optionally PYGM; wherein the disease is glycogen storage disease type IX and the defective gene is optionally PHKA1, PHKA2, PHKB, PHKG1, or PHKG2; wherein the disease is glycogen storage disease type XI and the defective gene is optionally $SLC2A_2$; wherein the disease is glycogen storage disease type XII and the defective gene is optionally ALDOA; wherein the disease is glycogen storage disease type XIII and the defective gene is optionally ENO1, ENO2, or ENO3; wherein the disease is glycogen storage disease type 0 and the defective gene is optionally GYS1 or GYS2; wherein the disease is pyruvate carboxylase deficiency and the defective gene is optionally PC; wherein the disease is pyruvate kinase deficiency and the defective gene is optionally PKLR; wherein the disease is transaldolase deficiency and the defective gene is optionally TALDO1; wherein the disease is triosephosphate isomerase deficiency and the defective gene is optionally TPI1; wherein the disease is fructose bisphosphatase deficiency and the defective gene is optionally FBP1; wherein the disease is hyperoxaluria and the defective gene is optionally AGXT or GRHPR; wherein the disease is hexokinase deficiency and the defective gene is optionally HK1; wherein the disease is glucose-galactose malabsorption and the defective gene is optionally SLC5A1; or wherein the disease is glucose-6-phosphate dehydrogenase deficiency and the defective gene is optionally G6PD.

In embodiments, the metabolic disorder is a disorder of amino acid metabolism wherein the disease is alkaptonuria and the defective gene is optionally HGD; wherein the disease is aspartylglucosaminuria and the defective gene is optionally AGA; wherein the disease is methylmalonic acidemia and the defective gene is optionally MUT, MCEE, MMAA, MMAB, MMACHC, MMADHC, or LMBRD1; wherein the disease is maple syrup urine disease and the defective gene is optionally BCKDHA, BCKDHB, DBT, or DLD; wherein the disease is homocystinuria and the defective gene is optionally CBS; wherein the disease is tyrosinemia and the defective gene is optionally FAH, TAT, or HPD; wherein the disease is trimethylaminuria and the defective gene is optionally FMO3; wherein the disease is Hartnup disease and the defective gene is optionally SLC6A19; wherein the disease is biotinidase deficiency and the defective gene is optionally BTD; wherein the disease is ornithine carbamoyltransferase deficiency and the defective gene is optionally OTC; wherein the disease is carbamoylphosphate synthase I deficiency disease and the defective gene is optionally CPS1; wherein the disease is citrullinemia and the defective gene is optionally ASS or SLC25A13; wherein the disease is hyperargininemia and the defective gene is optionally ARG1; wherein the disease is hyperhomocysteinemia and the defective gene is optionally MTHFR; wherein the disease is hypermethioninemia and the defective gene is optionally MAT1A, GNMT, or AHCY; wherein the disease is hyperlysinemias and the defective gene is optionally AASS; wherein the disease is nonketotic hyperglycinemia and the defective gene is optionally GLDC, AMT, or GCSH; wherein the disease is Propionic acidemia and the defective gene is optionally PCCA or PCCB; wherein the disease is hyperprolinemia and the defective gene is optionally ALDH4A1 or PRODH; wherein the disease is cystinuria and the defective gene is optionally SLC3A1 or SLC7A9; wherein the disease is dicarboxylic aminoaciduria and the defective gene is optionally SLC1A1; wherein the disease is glutaric acidemia type 2 and the defective gene is optionally ETFA, ETFB, or ETFDH; wherein the disease is isovaleric acidemia and the defective gene is optionally IVD; or wherein the disease is 2-hydroxyglutaric aciduria and the defective gene is optionally L2HGDH or D2HGDH.

In embodiments, the metabolic disorder is a disorder of the urea cycle wherein the disease is N-acetylglutamate synthase deficiency and the defective gene is optionally NAGS; wherein the disease is argininosuccinic aciduria and the defective gene is optionally ASL; or wherein the disease is argininemia and the defective gene is optionally ARG1.

In embodiments, the metabolic disorder is a disorder of fatty acid metabolism wherein the disease is very long-chain acyl-coenzyme A dehydrogenase deficiency and the defective gene is optionally ACADVL; wherein the disease is long-chain 3-hydroxyacyl-coenzyme A dehydrogenase deficiency and the defective gene is optionally HADHA; wherein the disease is medium-chain acyl-coenzyme A dehydrogenase deficiency and the defective gene is optionally ACADM; wherein the disease is short-chain acyl-coenzyme A dehydrogenase deficiency and the defective gene is optionally ACADS; wherein the disease is 3-hydroxyacyl-coenzyme A dehydrogenase deficiency and the defective gene is optionally HADH; wherein the disease is 2,4 dienoyl-CoA reductase deficiency and the defective gene is optionally NADK2; wherein the disease is 3-hydroxy-3-methylglutaryl-CoA lyase deficiency and the defective gene is optionally HMGCL; wherein the disease is malonyl-CoA decarboxylase deficiency and the defective gene is optionally MLYCD; wherein the disease is systemic primary carnitine deficiency and the defective gene is optionally SLC22A5; wherein the disease is carnitine-acylcarnitine translocase deficiency and the defective gene is optionally SLC25A20; wherein the disease is carnitine palmitoyltransferase I deficiency and the defective gene is optionally CPT1A; wherein the disease is carnitine palmitoyltransferase II deficiency and the defective gene is optionally CPT2; wherein the disease is lysosomal acid lipase deficiency and the defective gene is optionally LIPA; or wherein the disease is Gaucher's disease and the defective gene is optionally GBA.

In embodiments, the metabolic disorder is a disorder of porphyrin metabolism wherein the disease is acute intermittent porphyria and the defective gene is optionally HMBS; wherein the disease is Gunther disease and the defective gene is optionally UROS; wherein the disease is porphyria cutanea tarda and the defective gene is optionally UROD; wherein the disease is hepatoerythropoietic porphyria and the defective gene is optionally UROD; wherein the disease is hereditary coproporphyria and the defective gene is optionally CPDX; wherein the disease is variegate porphyria and the defective gene is optionally PPDX; wherein the disease is erythropoietic protoporphyria and the defective gene is optionally FECH; or wherein the disease is aminolevulinic acid dehydratase deficiency porphyria and the defective gene is optionally ALAD.

In embodiments, the metabolic disorder is a disorder of lysosomal storage wherein the disease is Farber disease and the defective gene is optionally ASAH1; wherein the disease is Krabbe disease and the defective gene is optionally GALC; wherein the disease is galactosialidosis and the defective gene is optionally CTSA; wherein the disease is fabry disease and the defective gene is optionally GLA; wherein the disease is Schindler disease and the defective gene is optionally NAGA; wherein the disease is GM1 gangliosidosis and the defective gene is optionally GLB1; wherein the disease is Tay-Sachs disease and the defective gene is optionally HEXA; wherein the disease is Sandhoff disease and the defective gene is optionally HEXB; wherein the disease is GM2-gangliosidosis, AB variant and the defective gene is optionally GM2A; wherein the disease is Niemann-Pick disease and the defective gene is optionally SMPD1, NPC1, or NPC2; wherein the disease is metachromatic leukodystrophy and the defective gene is optionally ARSA or PSAP; wherein the disease is multiple sulfatase deficiency and the defective gene is optionally SUMF1; wherein the disease is Hurler syndrome and the defective gene is optionally IDUA; wherein the disease is Hunter syndrome and the defective gene is optionally IDS; wherein the disease is Sanfilippo syndrome and the defective gene is optionally SGSH, NAGLU, HGSNAT, or GNS; wherein the disease is Morquio syndrome and the defective gene is optionally GALNS or GLB1; wherein the disease is Maroteaux-Lamy syndrome and the defective gene is optionally ARSB; wherein the disease is Sly syndrome and the defective gene is optionally GUSB; wherein the disease is sialidosis and the defective gene is optionally NEU1, NEU2, NEU3, or NEU4; wherein the disease is I-cell disease and the defective gene is optionally GNPTAB or GNPTG; wherein the disease is mucolipidosis type IV and the defective gene is optionally MCOLN1; wherein the disease is infantile neuronal ceroid lipofuscinosis and the defective gene is optionally PPT1 or PPT2; wherein the disease is Jansky-Bielschowsky disease and the defective gene is optionally TPP1; wherein the disease is Batten disease and the defective gene is optionally CLN1, CLN2, CLN3, CLN5, CLN6, MFSD8, CLN8, or CTSD; wherein the disease is Kufs disease, Type A and the defective gene is optionally CLN6 or PPT1; wherein the disease is Kufs disease, Type B and the defective gene is optionally DNAJC5 or CTSF; wherein the disease is alpha-mannosidosis and the defective gene is optionally MAN2B1, MAN2B2, or MAN2C1; wherein the disease is beta-mannosidosis and the defective gene is optionally MANBA; wherein the disease is fucosidosis and the defective gene is optionally FUCA1; wherein the disease is cystinosis and the defective gene is optionally CTNS; wherein the disease is pycnodysostosis and the defective gene is optionally CTSK; wherein the disease is Salla disease and the defective gene is optionally SLC17A5; wherein the disease is Infantile free sialic acid storage disease and the defective gene is optionally SLC17A5; or wherein the disease is Danon disease and the defective gene is optionally LAMP2.

In embodiments, the metabolic disorder is a disorder of peroxisome biogenesis wherein the disease is Zellweger syndrome and the defective gene is optionally PEX1, PEX2, PEX3, PEX5, PEX6, PEX12, PEX14, or PEX26; wherein the disease is Infantile Refsum disease and the defective gene is optionally PEX1, PEX2, or PEX26; wherein the disease is neonatal adrenoleukodystrophy and the defective gene is optionally PEX5, PEX1, PEX10, PEX13, or PEX26; wherein the disease is RCDP Type 1 and the defective gene is optionally PEX7; wherein the disease is pipecolic acidemia and the defective gene is optionally PAHX; wherein the disease is acatalasia and the defective gene is optionally CAT; wherein the disease is hyperoxaluria type 1 and the defective gene is optionally AGXT; wherein the disease is Acyl-CoA oxidase deficiency and the defective gene is optionally ACOX1; wherein the disease is D-bifunctional protein deficiency and the defective gene is optionally HSD17B4; wherein the disease is dihydroxyacetonephosphate acyltransferase deficiency and the defective gene is optionally GNPAT; wherein the disease is X-linked adrenoleukodystrophy and the defective gene is optionally ABCD1; wherein the disease is α-methylacyl-CoA racemase deficiency and the defective gene is optionally AMACR; wherein the disease is RCDP Type 2 and the defective gene is optionally DHAPAT; wherein the disease is RCDP Type 3 and the defective gene is optionally AGPS; wherein the disease is adult refsum disease-1 and the defective gene is optionally PHYH; or wherein the disease is mulibrey nanism and the defective gene is optionally TRIM37.

In embodiments, the metabolic disorder is a disorder of purine or pyrimidine metabolism wherein the disease is Lesch-Nyhan syndrome and the defective gene is optionally HPRT; wherein the disease is adenine phosphoribosyltransferase deficiency and the defective gene is optionally APRT; wherein the disease is adenosine deaminase deficiency and the defective gene is optionally ADA; wherein the disease is Adenosine monophosphate deaminase deficiency type 1 and the defective gene is optionally AMPD1; wherein the disease is adenylosuccinate lyase deficiency and the defective gene is optionally ADSL; wherein the disease is dihydropyrimidine dehydrogenase deficiency and the defective gene is optionally DPYD; wherein the disease is Miller syndrome and the defective gene is optionally DHODH; wherein the disease is orotic aciduria and the defective gene is optionally UMPS; wherein the disease is purine nucleoside phosphorylase deficiency and the defective gene is optionally PNP; or wherein the disease is xanthinuria and the defective gene is optionally XDH, MOCS1, or MOCS2, GEPH.

In embodiments, the present invention relates to a method for modulating transthyretin (TTR). The method comprising a step of administering an effective amount of a synthetic RNA encoding TTR to a subject, wherein the synthetic RNA comprises one or more non-canonical nucleotides that avoid substantial cellular toxicity.

In embodiments, the modulating results in an increase in the quantity of TTR in the subject.

In embodiments, the modulating results in a decrease in the quantity of TTR in the subject.

In embodiments, the modulating results in treatment of one or more of an amyloid disease, senile systemic amyloidosis (SSA), familial amyloid polyneuropathy (FAP), and familial amyloid cardiomyopathy (FAC).

In embodiments, the non-canonical nucleotides have one or more substitutions at positions selected from the 2C, 4C, and 5C positions for a pyrimidine, or selected from the 6C, 7N and 8C positions for a purine.

In embodiments, the present invention treats or reduces pain, e.g., post-surgical pain and/or chronic pain, by administering to a subject in need thereof an effective amount of a synthetic RNA encoding a gene-editing protein capable of creating a double-strand break in a voltage-gated sodium channel type 1 (NaV1) gene, e.g., NaV1.3, NaV1.7, NaV1.8, and/or NaV1.9.

In embodiments, the administering is directed to the central nervous system (CNS) or the peripheral nervous system (PNS), e.g., to neurons and glial cells of the CNS or PNS.

In embodiments, the disease or disorder is a lung disease or disorder. In embodiments, the disease or disorder is an inflammation is associated with a lung disease or disorder. In embodiments, the lung disease or disorder is selected from Asbestosis, Asthma, Bronchiectasis, Bronchitis, Chronic Cough, Chronic Obstructive Pulmonary Disease (COPD), Common Cold, Croup, Cystic Fibrosis, Hantavirus, Idiopathic Pulmonary Fibrosis, Influenza, Lung Cancer, Pandemic Flu, Pertussis, Pleurisy, Pneumonia, Pulmonary Embolism, Pulmonary Hypertension, Respiratory Syncytial Virus (RSV), Sarcoidosis, Sleep Apnea, Spirometry, Sudden Infant Death Syndrome (SIDS), and Tuberculosis.

Further still, in some embodiments, the present compositions may be used in the treatment, control, or prevention of a disease, disorder and/or condition and/or may alter, modify or change the appearance of a member of the integumentary system of a subject suffering from a disease, disorder and/or condition such as, but not limited to, acne vulgaris, acne aestivalis, acne conglobata, acne cosmetic, acne fulminans, acne keloidalis nuchae, acne mechanica, acne medicamentosa, acne miliaris necrotica, acne necrotica, acne rosacea, actinic keratosis, acne vulgaris, acne aestivalis, acne conglobata, acne cosmetic, acne fulminans, acne keloidalis nuchae, acne mechanica, acne medicamentosa, acne miliaris necrotica, acne necrotica, acne rosacea, acute urticaria, allergic contact dermatitis, alopecia areata, angioedema, athlete's foot, atopic dermatitis, autoeczematization, baby acne, balding, bastomycosis, blackheads, birthmarks and other skin pigmentation problems, boils, bruises, bug bites and stings, burns, cellulitis, chiggers, chloracne, cholinergic or stress uricara, chronic urticaria, cold type urticaria, confluent and reticulated papillomatosis, corns, cysts, dandruff, dermatitis herpetiformis, dermatographism, dyshidrotic eczema, diaper rash, dry skin, dyshidrosis, ectodermal dysplasia such as, hyprohidrotic ectodermal dysplasia and X-linked hyprohidrotic ectodermal dysplasia, eczema, epidermaodysplasia verruciformis, erythema nodosum, excoriated acne, exercise-induced anaphylasis folliculitis, excess skin oil, folliculitis, freckles, frostbite, fungal nails, hair density, hair growth rate, halogen acne, hair loss, heat rash, hematoma, herpes simplex infections (e.g. non-genital), hidradenitis suppurativa, hives, hyperhidrosis, hyperpigmentation, hypohidrotic ectodermal dysplasia, hypopigmentation, impetigo, ingrown hair, heat type urticaria, ingrown toenail, infantile acne or neonatal acne, itch, irritant contact dermatitis, jock itch, keloid, keratosis pilaris, lichen planus, lichen sclerosus, lupus miliaris disseminatus faciei, melasma, moles, molluscum contagiosum, nail growth rate, nail health, neurodermatitis, nummular eczema, occupational acne, oil acne, onychomycosis, physical urticara, pilonidal cyst, pityriasis rosea, pityriasis versicolor, poison ivy, pomade acne, pseudofolliculitis barbae or acne keloidalis nuchae, psoriasis, psoriatic arthritis, pressure or delayed pressue urticara, puncture wounds such as cuts and scrapes, rash, rare or water type urticaria, rhinoplasty, ringworm, rosacea, rothmund-thomson syndrome, sagging of the skin, scabis, scars, seborrhea, seborrheic dermatitis, shingles, skin cancer, skin tag, solar type urticaria, spider bite, stretch marks, sunburn, tar acne, tropical acne, thinning of skin, thrush, tinea versicolor, transient acantholytic dermatosis, tycoon's cap or acne necrotica miliaris, uneven skin tone, varicose veins, venous eczema, vibratory angioedema, vitiligo, warts, Weber-Christian disease, wrinkles, x-linked hypohidrotic ectodermal dysplasia, xerotic eczema, yeast infection and general signs of aging.

Illustrative cancers and/or tumors of the present invention include, but are not limited to, a basal cell carcinoma, biliary tract cancer; bladder cancer; bone cancer; brain and central nervous system cancer; breast cancer; cancer of the peritoneum; cervical cancer; choriocarcinoma; colon and rectum cancer; connective tissue cancer; cancer of the digestive system; endometrial cancer; esophageal cancer; eye cancer; cancer of the head and neck; gastric cancer (including gastrointestinal cancer); glioblastoma; hepatic carcinoma; hepatoma; intra-epithelial neoplasm; kidney or renal cancer; larynx cancer; leukemia; liver cancer; lung cancer (e.g., small-cell lung cancer, non-small cell lung cancer, adenocarcinoma of the lung, and squamous carcinoma of the lung); melanoma; myeloma; neuroblastoma; oral cavity cancer (lip, tongue, mouth, and pharynx); ovarian cancer; pancreatic cancer; prostate cancer; retinoblastoma; rhabdomyosarcoma; rectal cancer; cancer of the respiratory system; salivary gland carcinoma; sarcoma; skin cancer; squamous cell cancer; stomach cancer; testicular cancer; thyroid cancer; uterine or endometrial cancer; cancer of the urinary system; vulval cancer; lymphoma including Hodgkin's and non-Hodgkin's lymphoma, as well as B-cell lymphoma (including low grade/follicular non-Hodgkin's lymphoma (NHL); small lymphocytic (SL) NHL; intermediate grade/follicular NHL; intermediate grade diffuse NHL; high grade immunoblastic NHL; high grade lymphoblastic NHL; high grade small non-cleaved cell NHL; bulky disease NHL; mantle cell lymphoma; AIDS-related lymphoma; and Waldenstrom's Macroglobulinemia; chronic lymphocytic leukemia (CLL); acute lymphoblastic leukemia (ALL); Hairy cell leukemia; chronic myeloblastic leukemia; as well as other carcinomas and sarcomas; and post-transplant lymphoproliferative disorder (PTLD), as well as abnormal vascular proliferation associated with phakomatoses, edema (such as that associated with brain tumors), and Meigs' syndrome.

In embodiments, one or more rare diseases are treated, controlled or prevented with the present compositions, including, by way of illustration, Erythropoietic Protoporphyria, Hailey-Hailey Disease, Epidermolysis Bullosa (EB), Xeroderma Pigmentosum, Ehlers-Danlos Syndrome, Cutis Laxa, Protein C & Protein S Deficiency, Alport Syndrome, Striate Palmoplantar Keratoderma, Lethal Acantholytic EB, Pseudoxanthoma Elasticum (PXE), Ichthyosis Vulgaris, Pemphigus Vulgaris, and Basal Cell Nevus Syndrome.

In embodiments, the present compositions are used to treat, control or prevent one or more inflammatory diseases or conditions, such as inflammation, acute inflammation, chronic inflammation, respiratory disease, atherosclerosis, restenosis, asthma, allergic rhinitis, atopic dermatitis, septic shock, rheumatoid arthritis, inflammatory bowel disease, inflammatory pelvic disease, pain, ocular inflammatory disease, celiac disease, Leigh Syndrome, Glycerol Kinase Deficiency, Familial eosinophilia (FE), autosomal recessive spastic ataxia, laryngeal inflammatory disease; Tuberculosis, Chronic cholecystitis, Bronchiectasis, Silicosis and other pneumoconioses.

In embodiments, the present compositions are used to treat, control or prevent one or more autoimmune diseases or conditions, such as multiple sclerosis, diabetes mellitus, lupus, celiac disease, Crohn's disease, ulcerative colitis, Guillain-Barre syndrome, scleroderms, Goodpasture's syndrome, Wegener's granulomatosis, autoimmune epilepsy, Rasmussen's encephalitis, Primary biliary sclerosis, Sclerosing cholangitis, Autoimmune hepatitis, Addison's disease, Hashimoto's thyroiditis, Fibromyalgia, Menier's syndrome; transplantation rejection (e.g., prevention of allograft rejection) pernicious anemia, rheumatoid arthritis, systemic lupus erythematosus, dermatomyositis, Sjogren's syndrome, lupus erythematosus, multiple sclerosis, myasthenia gravis, Reiter's syndrome, Grave's disease, and other autoimmune diseases.

In embodiments, the present compositions are used to treat, control or prevent one or more neurologic diseases, including ADHD, AIDS—Neurological Complications, Absence of the Septum Pellucidum, Acquired Epileptiform Aphasia, Acute Disseminated Encephalomyelitis, Adrenoleukodystrophy, Agenesis of the Corpus Callosum, Agnosia, Aicardi Syndrome, Alexander Disease, Alpers' Disease, Alternating Hemiplegia, Alzheimer's Disease, Amyotrophic Lateral Sclerosis, Anencephaly, Aneurysm, Angelman Syndrome, Angiomatosis, Anoxia, Aphasia, Apraxia, Arachnoid Cysts, Arachnoiditis, Arnold-Chiari Malformation, Arteriovenous Malformation, Aspartame, Asperger Syndrome, Ataxia Telangiectasia, Ataxia, Attention Deficit-Hyperactivity Disorder, Autism, Autonomic Dysfunction, Back Pain, Barth Syndrome, Batten Disease, Behcet's Disease, Bell's Palsy, Benign Essential Blepharospasm, Benign Focal Amyotrophy, Benign Intracranial Hypertension, Bernhardt-Roth Syndrome, Binswanger's Disease, Blepharospasm, Bloch-Sulzberger Syndrome, Brachial Plexus Birth Injuries, Brachial Plexus Injuries, Bradbury-Eggleston Syndrome, Brain Aneurysm, Brain Injury, Brain and Spinal Tumors, Brown-Sequard Syndrome, Bulbospinal Muscular Atrophy, Canavan Disease, Carpal Tunnel Syndrome, Causalgia, Cavernomas, Cavernous Angioma, Cavernous Malformation, Central Cervical Cord Syndrome, Central Cord Syndrome, Central Pain Syndrome, Cephalic Disorders, Cerebellar Degeneration, Cerebellar Hypoplasia, Cerebral Aneurysm, Cerebral Arteriosclerosis, Cerebral Atrophy, Cerebral Beriberi, Cerebral Gigantism, Cerebral Hypoxia, Cerebral Palsy, Cerebro-Oculo-Facio-Skeletal Syndrome, Charcot-Marie-Tooth Disorder, Chiari Malformation, Chorea, Choreoacanthocytosis, Chronic Inflammatory Demyelinating Polyneuropathy (CIDP), Chronic Orthostatic Intolerance, Chronic Pain, Cockayne Syndrome Type II, Coffin Lowry Syndrome, Coma, including Persistent Vegetative State, Complex Regional Pain Syndrome, Congenital Facial Diplegia, Congenital Myasthenia, Congenital Myopathy, Congenital Vascular Cavernous Malformations, Corticobasal Degeneration, Cranial Arteritis, Craniosynostosis, Creutzfeldt-Jakob Disease, Cumulative Trauma Disorders, Cushing's Syndrome, Cytomegalic Inclusion Body Disease (CIBD), Cytomegalovirus Infection, Dancing Eyes-Dancing Feet Syndrome, Dandy-Walker Syndrome, Dawson Disease, De Morsier's Syndrome, Dejerine-Klumpke Palsy, Dementia—Multi-Infarct, Dementia-Subcortical, Dementia With Lewy Bodies, Dermatomyositis, Developmental Dyspraxia, Devic's Syndrome, Diabetic Neuropathy, Diffuse Sclerosis, Dravet's Syndrome, Dysautonomia, Dysgraphia, Dyslexia, Dysphagia, Dyspraxia, Dystonias, Early Infantile Epileptic Encephalopathy, Empty Sella Syndrome, Encephalitis Lethargica, Encephalitis and Meningitis, Encephaloceles, Encephalopathy, Encephalotrigeminal Angiomatosis, Epilepsy, Erb's Palsy, Erb-Duchenne and Dejerine-Klumpke Palsies, Fabry's Disease, Fahr's Syndrome, Fainting, Familial Dysautonomia, Familial Hemangioma, Familial Idiopathic Basal Ganglia Calcification, Familial Spastic Paralysis, Febrile Seizures (e.g., GEFS and GEFS plus), Fisher Syndrome, Floppy Infant Syndrome, Friedreich's Ataxia, Gaucher's Disease, Gerstmann's Syndrome, Gerstmann-Straussler-Scheinker Disease, Giant Cell Arteritis, Giant Cell Inclusion Disease, Globoid Cell Leukodystrophy, Glossopharyngeal Neuralgia, Guillain-Barre Syndrome, HTLV-1 Associated Myelopathy, Hallervorden-Spatz Disease, Head Injury, Headache, Hemicrania Continua, Hemifacial Spasm, Hemiplegia Alterans, Hereditary Neuropathies, Hereditary Spastic Paraplegia, Heredopathia Atactica Polyneuritiformis, Herpes Zoster Oticus, Herpes Zoster, Hirayama Syndrome, Holoprosencephaly, Huntington's Disease, Hydranencephaly, Hydrocephalus—Normal Pressure, Hydrocephalus, Hydromyelia, Hypercortisolism, Hypersomnia, Hypertonia, Hypotonia, Hypoxia, Immune-Mediated Encephalomyelitis, Inclusion Body Myositis, Incontinentia Pigmenti, Infantile Hypotonia, Infantile Phytanic Acid Storage Disease, Infantile Refsum Disease, Infantile Spasms, Inflammatory Myopathy, Intestinal Lipodystrophy, Intracranial Cysts, Intracranial Hypertension, Isaac's Syndrome, Joubert Syndrome, Kearns-Sayre Syndrome, Kennedy's Disease, Kinsbourne syndrome, Kleine-Levin syndrome, Klippel Feil Syndrome, Klippel-Trenaunay Syndrome (KTS), Kluver-Bucy Syndrome, Korsakoff's Amnesic Syndrome, Krabbe Disease, Kugelberg-Welander Disease, Kuru, Lambert-Eaton Myasthenic Syndrome, Landau-Kleffner Syndrome, Lateral Femoral Cutaneous Nerve Entrapment, Lateral Medullary Syndrome, Learning Disabilities, Leigh's Disease, Lennox-Gastaut Syndrome, Lesch-Nyhan Syndrome, Leukodystrophy, Levine-Critchley Syndrome, Lewy Body Dementia, Lissencephaly, Locked-In Syndrome, Lou Gehrig's Disease, Lupus—Neurological Sequelae, Lyme Disease—Neurological Complications, Machado-Joseph Disease, Macrencephaly, Megalencephaly, Melkersson-Rosenthal Syndrome, Meningitis, Menkes Disease, Meralgia Paresthetica, Metachromatic Leukodystrophy, Microcephaly, Migraine, Miller Fisher Syndrome, Mini-Strokes, Mitochondrial Myopathies, Mobius Syndrome, Monomelic Amyotrophy, Motor Neuron Diseases, Moyamoya Disease, Mucolipidoses, Mucopolysaccharidoses, Multi-Infarct Dementia, Multifocal Motor Neuropathy, Multiple Sclerosis, Multiple System Atrophy with Orthostatic Hypotension, Multiple System Atrophy, Muscular Dystrophy, Myasthenia-Congenital, Myasthenia Gravis, Myelinoclastic Diffuse Sclerosis, Myoclonic Encephalopathy of Infants, Myoclonus, Myopathy—Congenital, Myopathy—Thyrotoxic, Myopathy, Myotonia Congenita, Myotonia, Narcolepsy, Neuroacanthocytosis, Neurodegeneration with Brain Iron Accumulation, Neurofibromatosis, Neuroleptic Malignant Syndrome, Neurological Complications of AIDS, Neurological Manifestations of Pompe Disease, Neuromyelitis Optica, Neuromyotonia, Neuronal Ceroid Lipofuscinosis, Neuronal Migration Disorders, Neuropathy—Hereditary, Neurosarcoidosis, Neurotoxicity, Nevus Cavernosus, Niemann-Pick Disease, O'Sullivan-McLeod Syndrome, Occipital Neuralgia, Occult Spinal Dysraphism Sequence, Ohtahara Syndrome, Olivopontocerebellar Atrophy, Opsoclonus Myoclonus, Orthostatic Hypotension, Overuse Syndrome, Pain—Chronic, Paraneoplastic Syndromes, Paresthesia, Parkinson's Disease, Parnyotonia Congenita, Paroxysmal Choreoathetosis, Paroxysmal Hemicrania, Parry-Romberg, Pelizaeus-Merzbacher Disease, Pena Shokeir II Syndrome, Perineural Cysts, Periodic Paralyses, Peripheral Neuropathy, Periventricular Leukomalacia, Persistent Vegetative State, Pervasive Developmental Disorders, Phytanic Acid Storage Disease, Pick's Disease, Piriformis Syndrome, Pituitary Tumors, Polymyositis, Pompe Disease, Porencephaly, Post-Polio Syndrome, Postherpetic Neuralgia, Postinfectious Encephalomyelitis, Postural Hypotension, Postural Orthostatic Tachycardia Syndrome, Postural Tachycardia Syndrome, Primary Lateral Sclerosis, Prion Diseases, Progressive Hemifacial Atrophy, Progressive Locomotor Ataxia, Progressive Multifocal Leukoencephalopathy, Progressive Sclerosing Poliodystrophy, Progressive Supranuclear Palsy, Pseudotumor Cerebri, Pyridoxine Dependent and Pyridoxine Responsive Seizure Disorders, Ramsay Hunt Syndrome Type I, Ramsay Hunt Syndrome Type II, Rasmussen's Encephalitis and other autoimmune epilepsies, Reflex Sympathetic Dystrophy Syndrome, Refsum Disease—Infantile, Refsum Disease, Repetitive Motion Disorders, Repetitive Stress Injuries, Restless Legs Syndrome, Retrovirus-Associated Myelopathy, Rett Syndrome, Reye's Syndrome, Riley-Day Syndrome, SUNCT Headache, Sacral Nerve Root Cysts, Saint Vitus Dance, Salivary Gland Disease, Sandhoff Disease, Schilder's Disease, Schizencephaly, Seizure Disorders, Septo-Optic Dysplasia, Severe Myoclonic Epilepsy of Infancy (SMEI), Shaken Baby Syndrome, Shingles, Shy-Drager Syndrome, Sjogren's Syndrome, Sleep Apnea, Sleeping Sickness, Soto's Syndrome, Spasticity, Spina Bifida, Spinal Cord Infarction, Spinal Cord Injury, Spinal Cord Tumors, Spinal Muscular Atrophy, Spinocerebellar Atrophy, Steele-Richardson-Olszewski Syndrome, Stiff-Person Syndrome, Striatonigral Degeneration, Stroke, Sturge-Weber Syndrome, Subacute Sclerosing Panencephalitis, Subcortical Arteriosclerotic Encephalopathy, Swallowing Disorders, Sydenham Chorea, Syncope, Syphilitic Spinal Sclerosis, Syringohydromyelia, Syringomyelia, Systemic Lupus Erythematosus, Tabes Dorsalis, Tardive Dyskinesia, Tarlov Cysts, Tay-Sachs Disease, Temporal Arteritis, Tethered Spinal Cord Syndrome, Thomsen Disease, Thoracic Outlet Syndrome, Thyrotoxic Myopathy, Tic Douloureux, Todd's Paralysis, Tourette Syndrome, Transient Ischemic Attack, Transmissible Spongiform Encephalopathies, Transverse Myelitis, Traumatic Brain Injury, Tremor, Trigeminal Neuralgia, Tropical Spastic Paraparesis, Tuberous Sclerosis, Vascular Erectile Tumor, Vasculitis including Temporal Arteritis, Von Economo's Disease, Von Hippel-Lindau disease (VHL), Von Recklinghausen's Disease, Wallenberg's Syndrome, Werdnig-Hoffman Disease, Wernicke-Korsakoff Syndrome, West Syndrome, Whipple's Disease, Williams Syndrome, Wilson's Disease, X-Linked Spinal and Bulbar Muscular Atrophy, and Zellweger Syndrome.

In embodiments, the present compositions are used to treat and reduce pain, e.g., post-surgical pain or chronic pain.

In embodiments, the present compositions are used to treat Huntington's disease.

In embodiments, the present compositions are used to treat sickle-cell anemia or thalassemia.

In embodiments, the present compositions alter RNA splicing of exons associated with a disease or disorder. In embodiments, the disease or disorder is selected from Alport Syndrome, Alzheimer's disease, Bethlem myopathy and Ullrich scleroatonic muscular dystrophy, Duchenne muscular dystrophy, Dystrophic Epidermolysis Bullosa, Friedreich ataxia, Huntington's Disease, Junctional Epidermolysis Bullosa, Leber's congenital amaurosis (LCA), and various myopathies and dystrophies.

In embodiments, the present compositions are used to treat one or more respiratory diseases, such as asthma, chronic obstructive pulmonary disease (COPD), bronchiectasis, allergic rhinitis, sinusitis, pulmonary vasoconstriction, inflammation, allergies, impeded respiration, respiratory distress syndrome, cystic fibrosis, pulmonary hypertension, pulmonary vasoconstriction, emphysema, Hantavirus pulmonary syndrome (HPS), Loeffler's syndrome, Goodpasture's syndrome, Pleurisy, pneumonitis, pulmonary edema, pulmonary fibrosis, Sarcoidosis, complications associated with respiratory syncitial virus infection, and other respiratory diseases.

In embodiments, the present compositions are used to treat, control or prevent cardiovascular disease, such as a disease or condition affecting the heart and vasculature, including but not limited to, coronary heart disease (CHD), cerebrovascular disease (CVD), aortic stenosis, peripheral vascular disease, atherosclerosis, arteriosclerosis, myocardial infarction (heart attack), cerebrovascular diseases (stroke), transient ischaemic attacks (TIA), angina (stable and unstable), atrial fibrillation, arrhythmia, vavular disease, and/or congestive heart failure.

In embodiments, the present compositions are used to treat, control or prevent one or more metabolic-related disorders. In embodiments, the present invention is useful for the treatment, controlling or prevention of diabetes, including Type 1 and Type 2 diabetes and diabetes associated with obesity. The compositions and methods of the present invention are useful for the treatment or prevention of diabetes-related disorders, including without limitation diabetic nephropathy, hyperglycemia, impaired glucose tolerance, insulin resistance, obesity, lipid disorders, dyslipidemia, hyperlipidemia, hypertriglyceridemia, hypercholesterolemia, low HDL levels, high LDL levels, atherosclerosis and its sequelae, vascular restenosis, irritable bowel syndrome, inflammatory bowel disease, including Crohn's disease and ulcerative colitis, other inflammatory conditions, pancreatitis, abdominal obesity, neurodegenerative disease, retinopathy, neoplastic conditions, adipose cell tumors, adipose cell carcinomas, such as liposarcoma, prostate cancer and other cancers, including gastric, breast, bladder and colon cancers, angiogenesis, Alzheimer's disease, psoriasis, high blood pressure, Metabolic Syndrome (e.g. a person has three or more of the following disorders: abdominal obesity, hypertriglyceridemia, low HDL cholesterol, high blood pressure, and high fasting plasma glucose), ovarian hyperandrogenism (polycystic ovary syndrome), and other disorders where insulin resistance is a component, such as sleep apnea. The compositions and methods of the present invention are useful for the treatment, control, or prevention of obesity, including genetic or environmental, and obesity-related disorders. The obesity-related disorders herein are associated with, caused by, or result from obesity. Examples of obesity-related disorders include obesity, diabetes, overeating, binge eating, and bulimia, hypertension, elevated plasma insulin concentrations and insulin resistance, dyslipidemia, hyperlipidemia, endometrial, breast, prostate, kidney and colon cancer, osteoarthritis, obstructive sleep apnea, gallstones, heart disease, abnormal heart rhythms and arrythmias, myocardial infarction, congestive heart failure, coronary heart disease, sudden death, stroke, polycystic ovary disease, craniopharyngioma, Prader-Willi Syndrome, Frohlich's syndrome, GH-deficient subjects, normal variant short stature, Turner's syndrome, and other pathological conditions showing reduced metabolic activity or a decrease in resting energy expenditure as a percentage of total fat-free mass, e.g, children with acute lymphoblastic leukemia. Further examples of obesity-related disorders are Metabolic Syndrome, insulin resistance syndrome, reproductive hormone abnormalities, sexual and reproductive dysfunction, such as impaired fertility, infertility, hypogonadism in males and hirsutism in females, fetal defects associated with maternal obesity, gastrointestinal motility disorders, such as obesity-related gastro-esophageal reflux, respiratory disorders, such as obesity-hypoventilation syndrome (Pickwickian syndrome), breathlessness, cardiovascular disorders, inflammation, such as systemic inflammation of the vasculature, arteriosclerosis, hypercholesterolemia, lower back pain, gallbladder disease, hyperuricemia, gout, and kidney cancer, and increased anesthetic risk. The compositions and methods of the present invention are also useful to treat Alzheimer's disease.

Nucleic acids, including liposomal formulations containing nucleic acids, when delivered in vivo, can accumulate in the liver and/or spleen. It has now been discovered that nucleic acids encoding proteins can modulate protein expression in the liver and spleen, and that nucleic acids used in this manner can constitute potent therapeutics for the treatment of liver and spleen diseases. Certain embodiments are therefore directed to a method for treating liver and/or spleen disease by delivering to a patient a nucleic acid encoding a protein of interest. Other embodiments are directed to a therapeutic composition comprising a nucleic acid encoding a protein of interest, for the treatment of liver and/or spleen disease. Diseases and conditions of the liver and/or spleen that can be treated include, but are not limited to: hepatitis, alcohol-induced liver disease, drug-induced liver disease, Epstein Barr virus infection, adenovirus infection, cytomegalovirus infection, toxoplasmosis, Rocky Mountain spotted fever, non-alcoholic fatty liver disease, hemochromatosis, Wilson's Disease, Gilbert's Disease, and cancer of the liver and/or spleen.

In some embodiments, the present compositions and methods relate to the treatment of type 1 diabetes, heart disease, including ischemic and dilated cardiomyopathy, macular degeneration, Parkinson's disease, cystic fibrosis, sickle-cell anemia, thalassemia, Fanconi anemia, severe combined immunodeficiency, hereditary sensory neuropathy, xeroderma pigmentosum, Huntington's disease, muscular dystrophy, amyotrophic lateral sclerosis, Alzheimer's disease, cancer, and infectious diseases including hepatitis and HIV/AIDS.

In embodiments, the present methods and compositions find use in treating or preventing one or more metabolic diseases or disorders. In embodiments, the present methods and compositions find use in treating or preventing one or more of diseases or disorders of carbohydrate metabolism. diseases or disorders of amino acid metabolism, diseases or disorders of the urea cycle, diseases or disorders of fatty acid metabolism, diseases or disorders of porphyrin metabolism, lysosomal storage disorders, peroxisome biogenesis disorders, and diseases or disorders of purine or pyrimidine metabolism.

In embodiments, the present methods and compositions find use in treating or preventing one or more ophthalmologic diseases or disorders, including without limitation diabetic retinopathy, dry eye, cataracts, retinal vein occlusion, macular edema, macular degeneration (wet & dry), refraction and accommodation disorders, keratoconus, amblyopia, glaucoma, Stargardt disease, endophthalmitis, conjunctivitis, uveitis, retinal detachment, corneal ulcers, dacryocystitis, Duane retraction syndrome, and optic neuritis.

In embodiments, the ophthalmologic diseases or disorders is central serous retinopathy (CSR), adult vitelliform disease, uveitis, both primary and secondary to systemic disease (e.g. by way of non-limiting example, sarcoid, rheumatoid disease, the arthritidities, etc.), the white dot syndromes (including MEWDS (multiple evanescent white dot syndrome), serpiginous choroidopathy, AMPPE (acute multifocal posterior placoid epitheliopathy), POHS (presumed ocular histoplasmosis), or Serpiginous Chorioretinopathy. In some embodiments, the disease can be a maculopathy or cone dystrophy such as, by way or non-limiting example, Stargardt disease. In some embodiments, the disease can be an inherited degenerative disease such as Retinitis Pigmentosa (RP). In some embodiments, the ocular disease can be an ocular melanoma, an ocular tumor or an infiltrating tumor.

In embodiments, the ophthalmologic disease or disorder is Fuch's corneal dystrophy. In embodiments, the ophthalmologic disease or disorder is Leber congenital amaurosis.

In embodiments, the present methods and compositions find use in targeting any of the proteins or in treatment of any of the diseases or disorders of Table 2A, Table 2B, and/or Table 2C.

In various embodiments, the present methods and compositions include using a nucleic acid drug, including a synthetic RNA, in the diagnosing, treating, preventing or ameliorating of a disease, disorder and/or condition described herein. In various embodiments, the present methods and compositions include using a nucleic acid drug, including a synthetic RNA, in the altering, modifying and/or changing of a tissue (e.g. cosmetically).

Generally speaking, in various embodiments, a synthetic RNA as described herein is administered to a human at specific doses described herein and the synthetic RNA comprises a sequence, sometimes referred to as a target sequence that encodes a protein of interest, which may be a therapeutic protein.

Synthetic RNA comprising only canonical nucleotides can bind to pattern recognition receptors, can be recognized as a pathogen-associated molecular pattern, and can trigger a potent immune response in cells, which can result in translation block, the secretion of inflammatory cytokines, and cell death. Synthetic RNA comprising certain non-canonical nucleotides can evade detection by the innate immune system, and can be translated at high efficiency into protein, including in humans. Synthetic RNA comprising at least one of the non-canonical nucleotides described herein, including, for example, a member of the group: 5-methylcytidine, 5-hydroxycytidine, 5-hydroxymethylcytidine, 5-carboxycytidine, 5-formylcytidine, 5-methoxycytidine, pseudouridine, 5-hydroxyuridine, 5-methyluridine, 5-hydroxymethyluridine, 5-carboxyuridine, 5-methoxyuridine, 5-formyluridine, 5-hydroxypseudouridine, 5-methylpseudouridine, 5-hydroxymethylpseudouridine, 5-carboxypseudouridine, 5-methoxypseudouridine, and 5-formylpseudouridine can evade detection by the innate immune system, and can be translated at high efficiency into protein, including in humans. Certain embodiments are therefore directed to a method for inducing a cell to express a protein of interest comprising contacting a cell with synthetic RNA. Other embodiments are directed to a method for transfecting a cell with synthetic RNA comprising contacting a cell with a solution comprising one or more synthetic RNA molecules. Still other embodiments are directed to a method for treating a patient comprising administering to the patient synthetic RNA. In one embodiment, the synthetic RNA comprises at least one of the non-canonical nucleotides described herein, including, for example, a member of the group: 5-methylcytidine, 5-hydroxycytidine, 5-hydroxymethylcytidine, 5-carboxycytidine, 5-formylcytidine, 5-methoxycytidine, pseudouridine, 5-hydroxyuridine, 5-methyluridine, 5-hydroxymethyluridine, 5-carboxyuridine, 5-methoxyuridine, 5-formyluridine, 5-hydroxypseudouridine, 5-methylpseudouridine, 5-hydroxymethylpseudouridine, 5-carboxypseudouridine, 5-methoxypseudouridine, and 5-formylpseudouridine. In another embodiment, the synthetic RNA encodes a protein of interest. Illustrative RNAs may contain combinations and levels of non-canonical and non-canonical nucleotides as described elsewhere herein. In embodiments, the method results in the expression of the protein of interest. In embodiments, the method results in the expression of the protein of interest in the patient's skin.

Other embodiments are directed to a method for delivering a nucleic acid to a cell in vivo. Still other embodiments are directed to a method for inducing a cell in vivo to express a protein of interest. Still other embodiments are directed to a method for treating a patient. In one embodiment, the method comprises disrupting the stratum corneum. In another embodiment, the method comprises contacting a cell with a nucleic acid. In yet another embodiment, the method results in the cell internalizing the nucleic acid. In a further embodiment, the method results in the cell expressing the protein of interest. In a still further embodiment, the method results in the expression of the protein of interest in the patient. In a still further embodiment, the method results in the amelioration of one or more of the patient's symptoms. In a still further embodiment, the patient is in need of the protein of interest. In a still further embodiment, the patient is deficient in the protein of interest.

Still other embodiments are directed to a method for treating a patient comprising delivering to a patient a composition. In another embodiment, the composition comprises one or more nucleic acid molecules. In yet another embodiment, at least one of the one or more nucleic acid molecules encodes a protein of interest. In embodiments, the nucleic acid is synthetic RNA. In other embodiments, the method results in the amelioration of one or more of the patient's symptoms. Other embodiments are directed to a method for treating an indication by delivering to a cell or a patient a nucleic acid encoding a protein or a peptide. Still other embodiments are directed to a composition comprising a nucleic acid encoding a protein or a peptide. Indications that can be treated using the methods and compositions of the present invention and proteins and peptides that can be encoded by compositions of the present invention are set forth in Table 2A, Table 2B, and/or Table 2C, and are given by way of example, and not by way of limitation. In one embodiment, the indication is selected from Table 2A, Table 2B, and/or Table 2C. In another embodiment the protein or peptide is selected from Table 2A, Table 2B, and/or Table 2C. In yet another embodiment, the indication and the protein or peptide are selected from the same row of Table 2A, Table 2B, and/or Table 2C. In another embodiment, the protein is a gene-editing protein. In yet another embodiment, the gene-editing protein targets a gene that is at least partly responsible for a disease phenotype. In yet another embodiment, the gene-editing protein targets a gene that encodes a protein selected from Table 2A, Table 2B, and/or Table 2C.

In still another embodiment, the gene-editing protein corrects or eliminates, either alone or in combination with one or more other molecules or gene-editing proteins, a mutation that is at least partly responsible for a disease phenotype.

In various embodiments, the present invention contemplates the targeting of the precursor forms and/or mature forms and/or isoforms and/or mutants of any of the proteins disclosed in Table 2A, Table 2B, and/or Table 2C and such proteins. In embodiments, any of the precursor forms and/or mature forms and/or isoforms and/or mutants have enhanced secretion relative to the corresponding wild type proteins. In embodiments, any of the precursor forms and/or mature forms and/or isoforms and/or mutants have altered half-lives (e.g. serum, plasma, intracellular)—for instance, longer or shorter half-lives. In embodiments, this is relative to wild type.

TABLE 2A

Illustrative Indications

| Illustrative Indication | Illustrative Protein/Peptide |
|---|---|
| Acne | Retinol Dehydrogenase 10 |
| Aging | Elastin, sp|P15502|ELN_HUMAN Elastin, (isoform 3), (SEQ ID NO: 486) |
| Aging | Collagen Type I, P02452|CO1A1_HUMAN Collagen alpha-1(I) chain, (SEQ ID NO: 487); P08123|CO1A2_HUMAN Collagen alpha-2(I) chain, (SEQ ID NO: 488) |
| Aging | Collagen Type III, P02461|CO3A1_HUMAN Collagen alpha-1(III) chain, (isoform 1), (SEQ ID NO: 489) |
| Aging | Collagen Type VII, Q02388|CO7A1_HUMAN Collagen alpha-1(VII) chain, (SEQ ID NO: 490) |
| Aging | Hyaluronan Synthase |
| Aging | Telomerase Reverse Transcriptase |
| Albinism | Tyrosinase, P14679|TYRO_HUMAN Tyrosinase, (isoform 1), (SEQ ID NO: 491) |
| Alport Syndrome | Collagen Type IV; P02462|CO4A1_HUMAN Collagen alpha-1(IV) chain, (isoform 1), (SEQ ID NO: 492); P08572|CO4A2_HUMAN Collagen alpha-2(IV) chain, (SEQ ID NO: 493); Q01955|CO4A3_HUMAN Collagen alpha-3(IV) chain, (isoform 1), (SEQ ID NO: 494); P53420|CO4A4_HUMAN Collagen alpha-4(IV) chain, (SEQ ID NO: 495); P29400|CO4A5_HUMAN Collagen alpha-5(IV) chain, (isoform 1), (SEQ ID NO: 496); Q14031|CO4A6_HUMAN Collagen alpha-6(IV), (isoform A), (SEQ ID NO: 497) |
| Anemia | Erythropoietin |
| Atopic Dermatitis | Filaggrin |
| Cutis Laxa | Elastin, sp|P15502|ELN_HUMAN Elastin, (isoform 3), (SEQ ID NO: 486) |
| Dry Skin | Filaggrin |
| Dystrophic Epidermolysis Bullosa | Collagen Type VII; Q02388|CO7A1_HUMAN Collagen alpha-1(VII) chain, (SEQ ID NO: 498) |
| Ehlers-Danlos Syndrome | Collagen Type V; P20908|CO5A1_HUMAN Collagen alpha-1(V) chain, (SEQ ID NO: 499); P05997|CO5A2_HUMAN Collagen alpha-2(V) chain, (SEQ ID NO: 500); P25940|CO5A3_HUMAN Collagen alpha-3(V) chain, (SEQ ID NO: 501) |
| Ehlers-Danlos Syndrome | Collagen Type I, P02452|CO1A1_HUMAN Collagen alpha-1(I) chain, (SEQ ID NO: 487); P08123|CO1A2_HUMAN Collagen alpha-2(I) chain, (SEQ ID NO: 488) |
| Epidermolysis bullosa, lethal acantholytic | ADAM17, P78536|ADA17_HUMAN Disintegrin and metalloproteinase domain-containing protein 17, (isoform A), (SEQ ID NO: 502) |
| Epidermolysis bullosa, type IV | Collagen Type III, P02461|CO3A1_HUMAN Collagen alpha-1(III) chain, (isoform 1), (SEQ ID NO: 489) |
| Erythropoietic | Ferrochelatase, P22830|HEMH_HUMAN |

TABLE 2A-continued

Illustrative Indications

| Illustrative Indication | Illustrative Protein/Peptide |
|---|---|
| Protoporphyria | Ferrochelatase, mitochondrial, (isoform 1), (SEQ ID NO: 503) |
| Eczema | Filaggrin |
| Excess Fat | Thermogenin, P25874|UCP1_HUMAN Mitochondrial brown fat uncoupling protein 1, (SEQ ID NO: 504) |
| Excess Fat | Lipase; Lipoprotein lipase, P06858|LIPL_HUMAN Lipoprotein lipase, (SEQ ID NO: 516); Hepatic lipase, P11150|LIPC_HUMAN Hepatic triacylglycerol lipase, (SEQ ID NO: 517); Pancreatic lipase, P16233|LIPP_HUMAN Pancreatic triacylglycerol lipase, (SEQ ID NO: 518); Endothelial lipase, (isoform 1), Q9Y5X9|LIPE_HUMAN Endothelial lipase, (SEQ ID NO: 519); Lysosomal lipase, P38571|LICH_HUMAN Lysosomal acid lipase/cholesteryl ester hydrolase, (isoform 1), (SEQ ID NO: 520); Hormone sensitive lipase, Q05469|LIPS_HUMAN Hormone-sensitive lipas, (isoform 1), (SEQ ID NO: 521); Gastric lipase, P07098|LIPG_HUMAN Gastric triacylglycerol lipase, (isoform 1), (SEQ ID NO: 522); Pancreatic Lipase-Related Protein 1), P54315|LIPR1_HUMAN Inactive pancreatic lipase-related protein 1, (isoform 1), (SEQ ID NO: 523); Pancreatic Lipase-Related Protein 2, P54317|LIPR2_HUMAN Pancreatic lipase-related protein 2, (SEQ ID NO: 524); Carboxyl Ester Lipase, P19835|CEL_HUMAN Bile salt-activated lipase, (isoform long), (SEQ ID NO: 525) |
| Hypotrichosis | ADAM17, P78536|ADA17_HUMAN Disintegrin and metalloproteinase domain-containing protein 17, (isoform A), (SEQ ID NO: 502) |
| Ichthyosis Vulgaris | Filaggrin |
| Infections | Genetic Antibiotics (e.g. Anti-Sigma Factors) |
| Inflammatory and Bullous Skin Bowel Syndrome | Desmoglein 2, Q14126|DSG2_HUMAN Desmoglein-2, (SEQ ID NO: 505) |
| Keratosis Pilaris | Retinol Dehydrogenase 10 |
| Oily Skin | Retinol Dehydrogenase 10 |
| Osteoarthritis | Hyaluronan Synthase |
| Pemphigus Vulgaris | Plakophilin-1, Q13835|PKP1_HUMAN Plakophilin-1, (isoform 2), (SEQ ID NO: 506) |
| Pseudoxanthoma elasticum | Elastin, sp|P15502|ELN_HUMAN Elastin, (isoform 3), (SEQ ID NO: 486) |
| Psoriasis | Retinol Dehydrogenase 10 |
| Scar Treatment | Tyrosinase, P14679|TYRO_HUMAN Tyrosinase, (isoform 1), (SEQ ID NO: 491) |
| Scarring | Elastin, sp|P15502|ELN_HUMAN Elastin, (isoform 3), (SEQ ID NO: 486) |
| Scarring | Collagen Type 1, P02452|CO1A1_HUMAN Collagen alpha-1(I) chain, (SEQ ID NO: 487); P08123|CO1A2_HUMAN Collagen alpha-2(I) chain, (SEQ ID NO: 488) |
| Scarring | Collagen Type III, P02461|CO3A1_HUMAN Collagen alpha-1(III) chain, (isoform 1), (SEQ ID NO: 489) |
| Skin Cancer | Interferon; Interferon, Alpha 1, P01562|IFNA1_HUMAN Interferon alpha-1/13, (SEQ ID NO: 530); Interferon, Alpha 2, P01563|IFNA2_HUMAN Interferon alpha-2, (SEQ ID NO: 531); Interferon, Alpha 4, P05014|IFNA4_HUMAN Interferon alpha-4, (SEQ ID NO: 532); Interferon, Alpha 5, P01569|IFNA5_HUMAN Interferon alpha-5, (SEQ ID NO: 533), Interferon, Alpha 6, P05013|IFNA6_HUMAN Interferon alpha-6, (SEQ ID NO: 534); Interferon, Alpha 7, P01567|IFNA7_HUMAN Interferon alpha-7, (SEQ ID NO: 535); Interferon, Alpha 8, P32881|IFNA8_HUMAN Interferon alpha-8, (SEQ ID NO: 536); Interferon, Alpha 10, P01566|IFN10_HUMAN Interferon alpha-10, (SEQ ID NO: 537); Interferon, Alpha 14, P01570|IFN14_HUMAN Interferon alpha-14 OS, (SEQ ID NO: 538); Interferon, Alpha 16, P05015|IFN16_HUMAN Interferon alpha-16, (SEQ ID NO: 539); Interferon, Alpha 17, P01571|IFN17_HUMAN Interferon alpha-17, (SEQ ID NO: 540); Interferon, Alpha 21, P01568|IFN21_HUMAN Interferon alpha-21, (SEQ ID NO: 541); Interferon, Gamma, P01579|IFNG_HUMAN Interferon gamma, (SEQ ID NO: 542); Interferon, Beta, P01574|IFNB_HUMAN Interferon beta, (SEQ ID NO: 543); Interferon, Kappa, Q9P0W0|IFNK_HUMAN Interferon kappa, (SEQ ID NO: 544); Interferon, Epsilon, Q86WN2|IFNE_HUMAN Interferon epsilon, (SEQ ID NO: 545) |
| Striate Palmoplantar Keratoderma | ADAM17, P78536|ADA17_HUMAN Disintegrin and metalloproteinase domain-containing protein 17, (isoform A), (SEQ ID NO: 502) |
| Tanning | Tyrosinase, P14679|TYRO_HUMAN Tyrosinase, (isoform 1), (SEQ ID NO: 491) |
| Vitiligo | Melanocyte-Stimulating Hormone; Alpha-MSH, P01189|138-150, (SEQ ID NO: 526);, Beta-MSH, P01189|217-234, (SEQ ID NO: 527); Gamma-MSH, P01189|77-87, (SEQ ID NO: 528); Proopiomelanocortin, P01189|COLI_HUMAN Pro-opiomelanocortin, (SEQ ID NO: 529) |
| Vitiligo | Tyrosinase, P14679|TYRO_HUMAN Tyrosinase, (isoform 1), (SEQ ID NO: 491) |
| Warts | Interferon; Interferon, Alpha 1, P01562|IFNA1_HUMAN Interferon alpha-1/13, (SEQ ID NO: 530); Interferon, Alpha 2, P01563|IFNA2_HUMAN Interferon alpha-2, (SEQ ID NO: 531); Interferon, Alpha 4, P05014|IFNA4_HUMAN Interferon alpha-4, (SEQ ID NO: 532); Interferon, Alpha 5, P01569|IFNA5_HUMAN Interferon alpha-5, (SEQ ID NO: 533), Interferon, Alpha 6, P05013|IFNA6_HUMAN Interferon alpha-6, (SEQ ID NO: 534); Interferon, Alpha 7, P01567|IFNA7_HUMAN Interferon alpha-7, (SEQ ID NO: 535); Interferon, Alpha 8, P32881|IFNA8_HUMAN Interferon alpha-8, (SEQ ID NO: 536); Interferon, Alpha 10, P01566|IFN10_HUMAN Interferon alpha-10, (SEQ ID NO: 537); Interferon, Alpha 14, P01570|IFN14_HUMAN Interferon alpha-14 OS, (SEQ ID NO: 538); Interferon, Alpha 16, P05015|IFN16_HUMAN Interferon alpha-16, (SEQ ID NO: 539); Interferon, Alpha 17, P01571|IFN17_HUMAN Interferon alpha-17, (SEQ ID NO: 540); Interferon, Alpha 21, P01568|IFN21_HUMAN Interferon alpha-21, (SEQ ID NO: 541); Interferon, Gamma, P01579|IFNG_HUMAN Interferon gamma, (SEQ ID NO: 542); Interferon, Beta, P01574|IFNB_HUMAN Interferon beta, (SEQ ID NO: 543); Interferon, Kappa, Q9P0W0|IFNK_HUMAN Interferon kappa, (SEQ ID NO: 544); Interferon, Epsilon, Q86WN2|IFNE_HUMAN Interferon epsilon, (SEQ ID NO: 545) |
| Wound Healing | Elastin, sp|P15502|ELN_HUMAN Elastin, (isoform 3), (SEQ ID NO: 486) |
| Wound Healing | Collagen Type 1, P02452|CO1A1_HUMAN Collagen alpha-1(I) chain, (SEQ ID NO: 487); P08123|CO1A2_HUMAN Collagen alpha-2(I) chain, (SEQ ID NO: 488) |
| Wound Healing | Collagen Type III, P02461|CO3A1_HUMAN Collagen alpha-1(III) chain, (isoform 1), (SEQ ID NO: 489) |
| Xeroderma Pigmentosum | DNA Polymerase Eta, Q9Y253|POLH_HUMAN DNA polymerase eta, (isoform 1), (SEQ ID NO: 507) |

In Table 2B, all Illustrative Identifiers (e.g. Gene Seq nos. and references are hereby incorporated by reference in their entireties).

TABLE 2B

Illustrative Proteins and Illustrative Peptides

Protein/Peptide Illustrative Identifier Reference

Transthyretin (TTR), (SEQ ID NOs: 637 and 638), Gene ID: 7276
Endothelial Cell Specific Molecule 1, (SEQ ID NO: 784 and 785), Gene ID: 11082
Parathyroid hormone, P01270|PTHY_HUMAN Parathyroid hormone, (SEQ ID NO: 508)
BMP-1 GeneSeq Accession P80618 WO8800205, P13497/BMP1_HUMAN Bone morphogenetic protein 1, (isoform BMP1-3), (SEQ ID NO: 169)
P13497-2|BMP1_HUMAN Isoform BMP1-1 of Bone morphogenetic protein 1, (isoform BMP1-1), (SEQ ID NO: 509)
P13497-3|BMP1_HUMAN Isoform BMP1-4 of Bone morphogenetic protein 1, (isoform BMP1-4), (SEQ ID NO: 510)
P13497-4|BMP1_HUMAN Isoform BMP1-5 of Bone morphogenetic protein 1, (isoform BMP1-5), (SEQ ID NO: 511)
P13497-5|BMP1_HUMAN Isoform BMP1-6 of Bone morphogenetic protein 1, (isoform BMP1-6), (SEQ ID NO: 512)
P13497-6|BMP1_HUMAN Isoform BMP1-7 of Bone morphogenetic protein 1, (isoform BMP1-7), (SEQ ID NO: 513)
BMP-2 GeneSeq Accession P80619 WO8800205, P12643/BMP2_HUMAN Bone morphogenetic protein 2, (SEQ ID NO: 170)
BMP-3, P12645|BMP3_HUMAN Bone morphogenetic protein 3, (SEQ ID NO: 514)
BMP-2B GeneSeq Accession W24850 U.S. Pat. No. 5,631,142, P12644/BMP4_HUMAN Bone morphogenetic protein 4, (SEQ ID NO: 171)
BMP-4 GeneSeq Accession B02796 WO0020591, P12644/BMP4_HUMAN Bone morphogenetic protein 4, (SEQ ID NO: 172)
BMP-5 GeneSeq Accession B02797 WO0020591, P22003/BMP5_HUMAN Bone morphogenetic protein 5, (isoform 1), (SEQ ID NO: 173)
P22003-2|BMP5_HUMAN Isoform 2 of Bone morphogenetic protein 5, (isoform 2), (SEQ ID NO: 515)
BMP-6 GeneSeq Accession R32904 U.S. Pat. No. 5,187,076, P22004/BMP6_HUMAN Bone morphogenetic protein 6, (SEQ ID NO: 174)
Osteogenic Protein-1; OP-1; BMP-7 GeneSeq Accession W34783 WO973462, P18075/BMP7_HUMAN Bone morphogenetic protein 7, (SEQ ID NO: 175)
BMP7 Variant A, (SEQ ID NO: 579)
BMP7 Variant B, (SEQ ID NO: 580)
BMP7 Variant C, (SEQ ID NO: 581)
Osteogenic Protein-2 GeneSeq Accession R57973 WO9406399, P34820/BMP8B_HUMAN Bone morphogenetic protein 8B, (SEQ ID NO: 176)
GDF-1 GeneSeq Accession R60961 WO9406449, P27539/GDF1_HUMAN Embryonic growth/differentiation factor 1, (SEQ ID NO: 177)
BMP-9 GeneSeq Accession R86903 WO9533830, Q9UK05/GDF2_HUMAN Growth/differentiation factor 2, (SEQ ID NO: 178)
BMP-10 GeneSeq Accession R66202 WO9426893, O95393/BMP10_HUMAN Bone morphogenetic protein 10, (SEQ ID NO: 179)
BMP-12 GeneSeq Accession R78734 WO9516035, Q7Z4P5/GDF7_HUMAN Growth/differentiation factor 7, (SEQ ID NO: 180)
BMP-15 GeneSeq Accession W11261 WO9636710, O95972/BMP15_HUMAN Bone morphogenetic protein 15, (SEQ ID NO: 181)
BMP-17 GeneSeq Accession Y17870 WO9929718, SEQ ID NO: 2 from U.S. Pat. No. 7,151,086, (SEQ ID NO: 182)
BMP-18 GeneSeq Accession Y17871 WO9929718, SEQ ID NO: 4 from U.S. Pat. No. 7,151,086, (SEQ ID NO: 183)
Inhibin alpha GeneSeq Accession B02806 WO0020591, P05111/INHA_HUMAN Inhibin alpha chain, (SEQ ID NO: 184)
Inhibin beta GeneSeq Accession H02808 WO0020591, P08476/INHBA_HUMAN Inhibin beta A chain, (SEQ ID NO: 185)
P09529/INHBB_HUMAN Inhibin beta B chain, (SEQ ID NO: 186)
Cerberus Protein GeneSeq Accession W86032 WO9849296, O95813/CER1_HUMAN Cerberus, (SEQ ID NO: 187)
Soluble BMP Receptor Kinase Protein- 3 GeneSeq Accession R95227 WO9614579, Q13873/BMPR2_HUMAN Bone morphogenetic proteinreceptor type-2, (SEQ ID NO: 188)
BMP Processing Enzyme Furin GeneSeq Accession W36099 WO9741250, P09958/FURIN_HUMAN Furin, (SEQ ID NO: 189)
TGF-beta 1 GeneSeq Accession R29657 WO9216228, P01137/TGFB1_HUMAN Transforming growth factor beta-1, (SEQ ID NO: 190)
TGF-beta 2 GeneSeq Accession R39659 EP542679, P61812/TGFB2_HUMAN Transforming growth factor beta-2, (SEQ ID NO: 191)
ZTGF-beta 9 GeneSeq Accession Y70654 WO0015798, SEQ ID NO: 2 of WO0015798, (SEQ ID NO: 192)
Anti-TGF beta family antibodies GB2305921
Latent TGF beta binding protein II GeneSeq Accession Y70552 WO0012551, Q14767/LTBP2_HUMAN Latent-transforming growth factor beta-binding protein 2, (SEQ ID NO: 193)
MP52 GeneSeq Accession W36100 WO9741250, P43026/GDF5_HUMAN Growth/differentiation factor 5, (SEQ ID NO: 194)
b57 Protein GeneSeq Accession W69293 WO9837195, SEQ ID NO: 2 of WO9837195, (SEQ ID NO: 195)
Resistin GeneSeq Accession W69293 WO0064920, Q9HD89/RETN_HUMAN Resistin, (isoform 1), (SEQ ID NO: 196)
Galectin-4 GeneSeq Accession W11841 WO9703190, P56470/LEG4_HUMAN Galectin-4, (SEQ ID NO: 197)
APM-I; ACRP- 30; Famoxin GeneSeq Accession Y71035 W00026363, Q15848/ADIPO_HUMAN Adiponectin, (SEQ ID NO: 198)
ACRP-30 Homologue; Complement Component C1q C GeneSeq Accession B30234 WO0063376, P02747/C1QC_HUMAN Complement C1q subcomponent subunit C, (SEQ ID NO: 199)
Calpain-10a GeneSeq Accession Y79567 WO0023603, Q9HC96/CAN10_HUMAN Calpain-10, (isoform A), (SEQ ID NO: 200)
Calpain-10b GeneSeq Accession Y79568 WO0023603, Q9HC96-2/CAN10_HUMAN Isoform B of Calpain-10, (SEQ ID NO: 201)
Calpain-10c GeneSeq Accession Y79569 WO0023603, Q9HC96-3/CAN10_HUMAN Isoform C of Calpain-10, (SEQ ID NO: 202)
PDGF-D GeneSeq Accession Y71130 WO0027879, Q9GZP0/PDGFD_HUMAN Platelet-derived growth factor D, (isoform 1), (SEQ ID NO: 203)
FasL GeneSeq Accession Y28594 WO9936079, P48023/TNFL6_HUMAN Tumor necrosis factor ligand superfamily member 6, (isoform 1), (SEQ ID NO: 204)
Chondro modulin-like protein GeneSeq Accession Y71262 WO0029579, SEQ ID NO: 2 from WO0029579, (SEQ ID NO: 370)
Patched GeneSeq Accession W72969 U.S. Pat. No. 5,837,538, Q13635/PTC1_HUMAN Protein patched homolog 1, (isoform L), (SEQ ID NO: 205)
Patched-2 GeneSeq Accession Y43261 WO9953058, Q9Y6C5/PTC2_HUMAN Protein patched homolog 2, (isoform 1), (SEQ ID NO: 206)
Maspin; Protease Inhibitor 5 GeneSeq Accession R50938 WO9405804, P36952/SPB5_HUMAN Serpin B5, (isoform 1), (SEQ ID NO: 207)
Endostatin GeneSeq Accession B28399 WO0064946, P39060/COIA1_HUMAN Collagen alpha-1(XVIII) chain, (isoform 1), (SEQ ID NO: 208)
aFGF; FGF-1 GeneSeq Accession P94037 EP298723, P05230/FGF1_HUMAN Fibroblast growth factor 1, (isoform 1), (SEQ ID NO: 209)
bFGF; FGF-2 GeneSeq Accession R06685 FR2642086, P09038/FGF2_HUMAN Fibroblast growth factor 2, (isoform 1), (SEQ ID NO: 210)
FGF-3; INT-2 GeneSeq Accession R07824 WO9503831, P11487/FGF3_HUMAN Fibroblast growth factor 3, (SEQ ID NO: 211)
FGF-4; HST-1; HBGF-4 GeneSeq Accession R07825 WO9503831, P08620/FGF4_HUMAN Fibroblast growth factor 4, (isoform 1), (SEQ ID NO: 212)
FGF-5 GeneSeq Accession W22600 WO9730155, P12034/FGF5_HUMAN Fibroblast growth factor 5, (isoform long), (SEQ ID NO: 213)
FGF-6; Heparin binding secreted transforming factor-2 GeneSeq Accession R58555 EP613946, P10767/FGF6_HUMAN Fibroblast growth factor 6, (SEQ ID NO: 214)
FGF-8 GeneSeq Accession R80783 WO9524928, P55075/FGF8_HUMAN Fibroblast growth factor 8, (isoform 8E), (SEQ ID NO: 215)
FGF-9; Glia activating factor GeneSeq Accession R70822 WO9503831, P31371/FGF9_HUMAN Fibroblast growth factor 9, (SEQ ID NO: 216)

TABLE 2B-continued

Illustrative Proteins and Illustrative Peptides

Protein/Peptide Illustrative Identifier Reference

FGF-12; Fibroblast growth factor homologous factor-1 GeneSeq Accession W06309 WO9635708, P61328/FGF12_HUMAN Fibroblast growth factor 12, (isoform 1), (SEQ ID NO: 217)
FGF-19 GeneSeq Accession Y08582 WO9927100, O95750/FGF19_HUMAN Fibroblast growth factor 19, (SEQ ID NO: 218)
FGF-16 GeneSeq Accession Y05474 WO9918128, O43320/FGF16_HUMAN Fibroblast growth factor 16, (SEQ ID NO: 219)
FGF-18 GeneSeq Accession Y08590 WO9927100, O76093/FGF18_HUMAN Fibroblast growth factor 18, (SEQ ID NO: 220)
flt-3 ligand GeneSeq Accession R67541 EP627487, P49771|FLT3L_HUMAN Fms-related tyrosine kinase 3 ligand, (isoform 1), (SEQ ID NO: 221)
VEGF-110 GeneSeq Accession Y69417 WO0013702, SEQ ID NO: 11 from WO0013702, (SEQ ID NO: 222)
VEGF-121 GeneSeq Accession B50432 WO0071713, SEQ ID NO: 2 from WO0071713, (SEQ ID NO: 223)
VEGF-138 GeneSeq Accession Y43483 WO9940197, SEQ ID NO: 4 of WO99/40197, (SEQ ID NO: 371)
VEGF-145 GeneSeq Accession Y69413 WO0013702, SEQ ID NO: 4 from WO0013702, (SEQ ID NO: 224)
VEGF-162 GeneSeq Accession Y43484 WO9940197, SEQ ID NO: 8 of WO99/40197, (SEQ ID NO: 372)
VEGF-165 GeneSeq Accession Y69414 WO0013702, SEQ ID NO: 6 from WO0013702, (SEQ ID NO: 225)
VEGF-182 GeneSeq Accession Y43483 WO9940197, SEQ ID NO: 6 of WO99/40197, (SEQ ID NO: 373)
VEGF-189 GeneSeq Accession Y69415 WO0013702, SEQ ID NO: 8 from WO0013702, (SEQ ID NO: 226)
VEGF-206 GeneSeq Accession Y69416 WO0013702, SEQ ID NO: 10 from WO0013702, (SEQ ID NO: 227)
VEGF-D GeneSeq Accession W53240 WO9807832, O43915/VEGFD_HUMAN Vascular endothelial growth factor D, (SEQ ID NO: 374)
VEGF-E; VEGF-X GeneSeq Accession Y33679 WO9947677, SEQ ID NO: 2 from WO9947677, (SEQ ID NO: 228)
VEGF Receptor; KDR; flk-1 GeneSeq Accession W69679 WO9831794, P35968/VGFR2_HUMAN Vascular endothelial growth factor receptor 2, (isoform 1), (SEQ ID NO: 229)
Soluble VEGF Receptor GeneSeq Accession W47037 U.S. Pat. No. 5,712,380; sVEGF-RI (FIG. 3) of U.S. Pat. No. 5,712,380, (SEQ ID NO: 442); sVEGF-RII (FIG. 11) of U.S. Pat. No. 5,712,380, (SEQ ID NO: 443); sVEGF-RTMI (FIG. 15) of U.S. Pat. No. 5,712,380, (SEQ ID NO: 444); sVEGF-RTMII (FIG. 13) of U.S. Pat. No. 5,712,380, (SEQ ID NO: 445)
flt-1 GeneSeq Accession Y70751 WO0021560, P17948/VGFR1_HUMAN Vascular endothelial growth factor receptor 1, (isoform 1), (SEQ ID NO: 230)
VEGF R-3; flt-4 GeneSeq Accession B29047 WO0058511, P35916/VGFR3_HUMAN Vascular endothelial growth factor receptor 3, (isoform 1), (SEQ ID NO: 231)
Neuropilin-1 GeneSeq Accession Y06319 WO9929858, O14786/NRP1_HUMAN Neuropilin-1, (isoform 1), (SEQ ID NO: 232)
Neuropilin-2 GeneSeq Accession Y03618 WO9929858, O60462/NRP2_HUMAN Neuropilin-2, (isoform A22), (SEQ ID NO: 233)
Human fast twitch skeletal muscle troponin C GeneSeq Accession W22597 WO9730085, P02585/TNNC2_HUMAN Troponin C, skeletal muscle, (SEQ ID NO: 234)
Human fast twitch skeletal muscle troponin I GeneSeq Accession W18054 WO9730085, P48788/TNNI2_HUMAN Troponin 1, fast skeletal muscle, (isoform 1), (SEQ ID NO: 235)
Human fast twitch skeletal muscle troponin T GeneSeq Accession W22599 WO9730085, SEQ ID NO: 3 of WO9730085, (SEQ ID NO: 236)
Fragment. myofibrillar protein troponin I GeneSeq Accession W18053 WO9719955, SEQ ID NO: 3 of WO9719955, (SEQ ID NO: 237)
myofibrillar protein troponin I GeneSeq Accession W18054 WO9719955, SEQ ID NO: 3 of WO9719955, (SEQ ID NO: 237)
Troponin peptides GeneSeq Accessions Y29581, Y29582, Y29583, Y29584, Y29585, and Y29586 WO9933874. Wildtype troponins provided as: Human fast twitch skeletal muscle troponin C GeneSeq Accession W22597 WO9730085, P02585/TNNC2_HUMAN Troponin C, skeletal muscle, (SEQ ID NO: 234); Human fast twitch skeletal muscle troponin I GeneSeq Accession W18054 WO9730085, P48788/TNNI2_HUMAN Troponin I, fast skeletal muscle, (isoform 1), (SEQ ID NO: 235); Human fast twitch skeletal muscle troponin T GeneSeq Accession W22599 WO9730085, SEQ ID NO: 3 of WO9730085, (SEQ ID NO: 236); fragment. myofibrillar protein troponin I GeneSeq Accession W18053 WO9719955, SEQ ID NO: 3 of WO9719955, (SEQ ID NO: 237); Human fast twitch skeletal muscle Troponin subunit C GeneSeq Accession B00134 WO0054770, SEQ ID NO: 1 of WO0054770, (SEQ ID NO: 375); Human fast twitch skeletal muscle Troponin subunit I Protein GeneSeq Accession B00135 WO0054770, SEQ ID NO: 2 of WO0054770, (SEQ ID NO: 376); Human fast twitch skeletal muscle Troponin subunit T GeneSeq Accession B00136 WO0054770, SEQ ID NO: 3 of WO0054770, (SEQ ID NO: 377)
Human fast twitch skeletal muscle Troponin subunit C GeneSeq Accession B00134 WO0054770, SEQ ID NO: 1 of WO0054770, (SEQ ID NO: 375)
Human fast twitch skeletal muscle Troponin subunit I Protein GeneSeq Accession B00135 WO0054770, SEQ ID NO: 2 of WO0054770, (SEQ ID NO: 376)
Human fast twitch skeletal muscle Troponin subunit T GeneSeq Accession B00136 WO0054770, SEQ ID NO: 3 of WO0054770, (SEQ ID NO: 377)
Activator lnhibitor-1; PAI-1 GeneSeq Accession R08411 WO9013648, P05121/PAI1_HUMAN Plasminogen activator inhibitor 1, (isoform 1), (SEQ ID NO: 238)
Plasminogen Activator Inhibitor-2; PAI-2 GeneSeq Accession P94160 DE3722673, P05120/PAI2_HUMAN Plasminogen activator inhibitor 2, (SEQ ID NO: 239)
Activator Inhibitor-2; PAI-2 GeneSeq Accession R10921 WO9102057, P05120/PAI2_HUMAN Plasminogen activator inhibitor 2, (SEQ ID NO: 239)
Human PAI-1 mutants GeneSeq Accessions R11755, R11756, R11757, R11758, R11759, R11760, R11761, R11762 and R11763 WO9105048, Wildtype PAI-1 is provided as P05121/PAI1_HUMAN Plasminogen activator inhibitor 1, (isoform 1), (SEQ ID NO: 238)
CXCR3; CXC GeneSeq Accession Y79372 WO0018431, P49682|CXCR3_HUMAN C-X-C chemokine receptor type 3, (isoform 1), (SEQ ID NO: 240)
Modified Rantes GeneSeq Accession W38129 WO9737005, Wildtype Rantes provided herein as P13501/CCL5_HUMAN C-C motif chemokine 5, (SEQ ID NO: 241)
RANTES GeneSeq Accession Y05299 EP905240, P13501/CCL5_HUMAN C-C motif chemokine 5, (SEQ ID NO: 241)
MCP-Ia GeneSeq Accession R73914 WO9509232, MCP-1 provided as P13500/CCL2_HUMAN C-C motif chemokine 2, (SEQ ID NO: 337)
MCP-Ib GeneSeq Accession Y26176 WO9929728, MCP-1 provided as P13500/CCL2_HUMAN C-C motif chemokine 2, (SEQ ID NO: 337)
MCP-I receptor GeneSeq Accession R79165 WO9519436: MCP-1A, SEQ ID NO: 2 of WO9519436, (SEQ ID NO: 446); MCP-1B, SEQ ID NO: 4 of WO9519436, (SEQ ID NO: 447)
MCP-3 GeneSeq Accession R73915 WO9509232, P80098/CCL7_HUMAN C-C motif chemokine 7, (SEQ ID NO: 336)
MCP-4 receptor GeneSeq Accession W56689 WO9809171, SEQ ID NO: 2 of WO9809171, (SEQ ID NO: 378)
RANTES receptor GeneSeq Accession W29588 U.S. Pat. No. 5,652,133, SEQ ID NO: 2 of U.S. Pat. No. 5,652,133, (SEQ ID NO: 379)
CR5 variant GeneSeq Accession W88238 WO9854317, Variants of wildtype CCR5 which has the sequence, of: P51681|CCR5_HUMAN C-C chemokine receptor type 5, (SEQ ID NO: 448)

TABLE 2B-continued

Illustrative Proteins and Illustrative Peptides

Protein/Peptide Illustrative Identifier Reference

CCR7 GeneSeq Accession B50859 U.S. Pat. No. 6,153,441, P32248/CCR7_HUMAN C-C chemokine receptor type 7, (SEQ ID NO: 243)
CXC3 GeneSeq Accession W23345 WO9727299, P78423/X3CL1_HUMAN Fractalkine, (SEQ ID NO: 244)
Eotaxin GeneSeq Accession W10099 WO9700960, P51671/CCL11_HUMAN Eotaxin, (SEQ ID NO: 245)
Neurotactin GeneSeq Accessions Y77537, W34307, Y53259, and, Y77539 U.S. Pat. No. 6,013,257 WO9742224, P78423/X3CL1_HUMAN Fractalkine, (SEQ ID NO: 244)
Human CKbeta-9 GeneSeq Accession B50860 U.S. Pat. No. 6,153,441, SEQ ID NO: 2 of U.S. Pat. No. 6,153,441, (SEQ ID NO: 246)
Lymphotactin GeneSeq Accession B50052 WO0073320, P47992/XCL1_HUMAN Lymphotactin, (SEQ ID NO: 247)
MIP-3 alpha GeneSeq Accession W44398 WO9801557, P78556/CCL20_HUMAN C-C motif chemokine 20, (isoform 1), (SEQ ID NO: 248)
MIP-3 beta GeneSeq Accession W44399 WO9801557, Q99731/CCL19_HUMAN C-C motif chemokine 19, (SEQ ID NO: 249)
MIP-Gamma GeneSeq Accession R70798, WO2006135382, (SEQ ID NO: 457)
Stem Cell Inhibitory Factor GeneSeq Accession R11553 WO9104274, SCIF in Table I of WO9104274, (SEQ ID NO: 380); SCIF in Table II of WO9104274, (SEQ ID NO: 381)
Thrombopoietin GeneSeq Accession R79905 WO9521920, P40225|TPO_HUMAN Thrombopoietin, (isoform 1), (SEQ ID NO: 250)
c-kit ligand; SCF; Mast cell growth factor; MGF; Fibrosarcoma- derived stem cell factor GeneSeq Accession Y53284, R83978 and R83977 EP992579 and EP676470, P21583|SCF_HUMAN Kit ligand, (isoform 1), (SEQ ID NO: 251)
Platelet derived growth factor GeneSeq Accession B48653 WO0066736, PDGF-A, P04085/PDGFA_HUMAN Platelet-derived growth factor subunit A, (Isoform long), (SEQ ID NO: 257); PDGF-B, P01127/PDGFB_HUMAN Platelet-derived growth factor subunit B, (isoform 1), (SEQ ID NO: 258)
Melanoma inhibiting protein GeneSeq Accession R69811 WO9503328, (SEQ ID NO: 458)
Glioma-derived growth factor GeneSeq Accession R08120 EP399816
Platelet derived growth factor precursor A GeneSeq Accession R84759 EP682110, PDGF-A precursor (variant D1), (SEQ ID NO: 382); PDGF-A precursor (variant 13-1), (SEQ ID NO: 383)
Platelet derived growth factor precursor B GeneSeq Accession R84760 EP682110, FIG. 1 or FIG. 2, Wildtype PDGF-B provided as:, PDGF-B, P01127/PDGFB_HUMAN Platelet-derived growth factor subunit B, (isoform 1), (SEQ ID NO: 258)
Platelet derived growth factor Bvsis GeneSeq Accession P80595 and P80596 EP282317, FIG. 1 of EP282317, (SEQ ID NO: 384)
Placental Growth Factor GeneSeq Accessions R23059 and R23060 WO9206194, P49763-2/PLGF_HUMAN Isoform PlGF-1 of Placenta growth factor, (isoform PIGF-1), (SEQ ID NO: 252)
Placental Growth Factor- 2 GeneSeq Accession Y08289 DE19748734, P49763-3/PLGF_HUMAN Isoform PlGF-2 of Placenta growth factor, (isoform PIGF-2), (SEQ ID NO: 253)
Thrombopoietin derivative1 GeneSeq Accession Y77244 WO0000612 (e.g. Table 3), Wildtype thrombopoietin provided as:, P40225|TPO_HUMAN Thrombopoietin, (isoform 1), (SEQ ID NO: 250)
Thrombopoietin derivative2 GeneSeq Accession Y77255 WO0000612 (e.g. Table 3), Wildtype thrombopoietin provided as:, P40225|TPO_HUMAN Thrombopoietin, (isoform 1), (SEQ ID NO: 250)
Thrombopoietin derivative 3 GeneSeq Accession Y77262, WO0000612 (e.g. Table 3), Wildtype thrombopoietin provided as:, P40225|TPO_HUMAN Thrombopoietin, (isoform 1), (SEQ ID NO: 250)
Thrombopoietin derivative 4 GeneSeq Accession Y77267, WO0000612 (e.g. Table 3), Wildtype thrombopoietin provided as:, P40225|TPO_HUMAN Thrombopoietin, (isoform 1), (SEQ ID NO: 250)
Thrombopoietin derivative 5 GeneSeq Accession Y77246, WO0000612 (e.g. Table 3), Wildtype thrombopoietin provided as:, P40225|TPO_HUMAN Thrombopoietin, (isoform 1), (SEQ ID NO: 250)
Thrombopoietin derivative 6 GeneSeq Accession Y77253, WO0000612 (e.g. Table 3), Wildtype thrombopoietin provided as:, P40225|TPO_HUMAN Thrombopoietin, (isoform 1), (SEQ ID NO: 250)
Thrombopoietin derivative, 7 GeneSeq Accession Y77256, WO0000612 (e.g. Table 3), Wildtype thrombopoietin provided as:, P40225|TPO_HUMAN Thrombopoietin, (isoform 1), (SEQ ID NO: 250)
Fractalkine GeneSeq Accession Y53255 U.S. Pat. No. 6,043,086, P78423/X3CL1_HUMAN Fractalkine, (SEQ ID NO: 244)
CXC3 GeneSeq Accession W23345 WO9757599, P78423/X3CL1_HUMAN Fractalkine, (SEQ ID NO: 244)
CCR7 GeneSeq Accession B50859 U.S. Pat. No. 6,153,441, P32248/CCR7_HUMAN C-C chemokine receptor type 7, (SEQ ID NO: 243)
Nerve Growth Factor-beta GeneSeq Accession R11474 EP414151, P01138/NGF_HUMAN Beta-nerve growth factor, (SEQ ID NO: 254)
Nerve Growth Factor-beta2 GeneSeq Accession W69725 EP859056, FIG. 1 of EP859056, (SEQ ID NO: 465)
Neurotrophin-3 GeneSeq Accession W8889 WO9821234, P20783/NTF3_HUMAN Neurotrophin-3, (isoform 1), (SEQ ID NO: 255)
Neurotrophin-4 GeneSeq Accession R47100 WO9325684, P34130/NTF4_HUMAN Neurotrophin-4, (SEQ ID NO: 256)
Neurotrophin- 4a GeneSeq Accession R47101 WO9325684, Wildtype neurotrophin provided as:, P34130/NTF4_HUMAN Neurotrophin-4, (SEQ ID NO: 256)
Neurotrophin- 4b GeneSeq Accession R47102 WO9325684, P34130/NTF4_HUMAN Neurotrophin-4, (SEQ ID NO: 256)
Neurotrophin- 4c GeneSeq Accession R47103 WO9325684, P34130/NTF4_HUMAN Neurotrophin-4, (SEQ ID NO: 256)
Neurotrophin- 4d GeneSeq Accession R47102 WO9325684, P34130/NTF4_HUMAN Neurotrophin-4, (SEQ ID NO: 256)
Platelet-Derived Growth Factor A chain GeneSeq Accession R38918 U.S. Pat. No. 5,219,739, P04085/PDGFA_HUMAN Platelet-derived growth factor subunit A, (Isoform long), (SEQ ID NO: 257)
Platelet-Derived Growth Factor B chain GeneSeq Accession R38919 U.S. Pat. No. 5,219,739, P01127/PDGFB_HUMAN Platelet-derived growth factor subunit B, (isoform 1), (SEQ ID NO: 258)
Stromal Derived Factor- 1 alpha GeneSeq Accession Y39995 WO9948528, P48061-2/SDF1_HUMAN Isoform Alpha of Stromal cell-derived factor 1, (isoform alpha), (SEQ ID NO: 259)
Stromal Derived Factor- 1 beta GeneSeq Accession R75420 CA2117953, P48061/SDF1_HUMAN Stromal cell-derived factor 1, (isoform beta), (SEQ ID NO: 260)
Tarc GeneSeq Accession W14917 WO9711969, Q92583/CCL17_HUMAN C-C motif chemokine 17, (SEQ ID NO: 261)
Prolactin GeneSeq Accession R78691 WO9521625, P01236/PRL_HUMAN Prolactin, (SEQ ID NO: 262)
Prolactin2 GeneSeq Accession Y31764 U.S. Pat. No. 5,955,346
Follicle stimulating hormone Alpha subunit GeneSeq Accession Y54160 EP974359, P01215/GLHA_HUMAN Glycoprotein hormones alpha chain, (SEQ ID NO: 263)
Follicle stimulating hormone Beta subunit GeneSeq Accession Y54161 EP974359, P01225/FSHB_HUMAN Follitropin subunit beta, (SEQ ID NO: 264)
Substance P (tachykinin) GeneSeq Accession B23027 WO0054053, (SEQ ID NO: 385)
Oxytocin (Neurophysin I) GeneSeq Accession B24085 and B24086 WO0053755, P01178/NEU1_HUMAN Oxytocin-neurophysin 1, (SEQ ID NO: 265)

TABLE 2B-continued

Illustrative Proteins and Illustrative Peptides

Protein/Peptide Illustrative Identifier Reference

Vasopressin (Neurophysin II) GeneSeq Accession B24085 and B24086 WO0053755, P01185/NEU2_HUMAN Vasopressin-neurophysin 2-copeptin, (SEQ ID NO: 266)
IL-1 GeneSeq Accession P60326 EP165654, IL-1 alpha, P01583|IL1A_HUMAN Interleukin-1 alpha, (SEQ ID NO: 269); IL-1 beta, P01584|IL1B_HUMAN Interleukin-1 beta, (SEQ ID NO: 267)
IL-1 mature GeneSeq Accession R14855 EP456332, (mature truncated form wherein the precursor is cleaved between amino acids 116-117), (SEQ ID NO: 386)
IL-1 beta GeneSeq Accession Y08322 WO9922763, P01584|IL1B_HUMAN Interleukin-1 beta, (SEQ ID NO: 267)
IL-3 variants GeneSeq Accession P80382, P80383, P80384, and P80381 WO8806161, Variants of wildtype IL-3 which has the sequence:, P08700|IL3_HUMAN Interleukin-3, (SEQ ID NO: 449)
IL-4 GeneSeq Accession P70615 WO8702990, P05112/IL4_HUMAN Interleukin-4, (isoform 1), (SEQ ID NO: 268)
IL-4 muteins GeneSeq Accession W52151 W52152 W52153 W52154 W52155 W52156 W52157 W52158 W52159 W52160 W52161 W52162 W52163 W52164 and W52165 WO9747744, Variants of wildtype IL-4 which has the sequence:, P05112/IL4_HUMAN Interleukin-4, (isoform 1), (SEQ ID NO: 268)
IL-1 alpha GeneSeq Accession P90108 EP324447, P01583|IL1A_HUMAN Interleukin-1 alpha, (SEQ ID NO: 269)
IL-3 variants GeneSeq Accession R38561, R38562, R38563, R38564, R38565, R38566, R38567, R38568, R38569, R38570, R38571, and R38572 WO9307171, Variants of wildtype IL-3 which has the sequence:, P08700|1L3_HUMAN Interleukin-3, (SEQ ID NO: 449)
IL-6 GeneSeq Accession R45717 and R45718 WO9402512, P05231/IL6_HUMAN Interleukin-6, (SEQ ID NO: 270)
IL-13 GeneSeq Accession R48624 WO9404680, P35225/IL13_HUMAN Interleukin-13, (SEQ ID NO: 271)
IL-4 mutein GeneSeq Accession R47182 DE4137333, Variants of wildtype IL-4 which has the sequence:, P05112/IL4_HUMAN Interleukin-4, (isoform 1), (SEQ ID NO: 268)
IL-4 mutein Y124X GeneSeq Accession R47183 DE4137333, Variants of wildtype IL-4 which has the sequence:, P05112/IL4_HUMAN Interleukin-4, (isoform 1), (SEQ ID NO: 268))
IL-4 mutein Y124G GeneSeq Accession R47184 DE4137333, Variants of wildtype IL-4 which has the sequence:, P05112/IL4_HUMAN Interleukin-4, (isoform 1), (SEQ ID NO: 268)
Human Interleukin-10 (precursor) GeneSeq Accession R41664 WO9317698, P22301/IL10_HUMAN Interleukin-10, (precursor form is processed into a truncated mature form), (SEQ ID NO: 272)
Human Interleukin-10 GeneSeq Accession R42642 WO9318783-A, SEQ ID NO: 3 of WO9318783-A, (mature IL-10), (SEQ ID NO: 273)
Human interleukin-1 beta precursor. GeneSeq Accession R42447 EP569042, P01584/IL1B_HUMAN Interleukin-1 beta, (SEQ ID NO: 274)
Interleukin- 1alpha GeneSeq Accession R45364 EP578278, P01583|IL1A_HUMAN Interleukin-1 alpha, (SEQ ID NO: 269)
Human interleukin-3 variant GeneSeq Accession R22814 JP04063595, Variants of wildtype IL-3 which has the sequence:, P08700|IL3_HUMAN Interleukin-3, (SEQ ID NO: 449)
IL-1i fragments GeneSeq Accession R35484 and R35485 EP541920
IL-1 inhibitor (IL-li) GeneSeq Accession R35486 and R35484 EP5541920
ICE 22 kD subunit. GeneSeq Accession R33780 EP533350, SEQ ID NO: 16 of EP533350, (SEQ ID NO: 450)
ICE 20 kD subunit. GeneSeq Accession R33781 EP533350, SEQ ID NO: 17 of EP533350, (SEQ ID NO: 451)
ICE 10 kD subunit GeneSeq Accession R33782 EP533350, SEQ ID NO: 18 of EP533350, (SEQ ID NO: 452)
Human Interleukin-10 (precursor) GeneSeq Accession R41664 WO9317698, P22301/IL10_HUMAN Interleukin-10, (precursor form is processed into a truncated mature form), (SEQ ID NO: 272)
Human Interleukin-10 GeneSeq Accession R42642 WO9318783, SEQ ID NO: 3 of WO9318783-A, (mature IL-10), (SEQ ID NO: 273)
Human Interleukin-1 beta precursor GeneSeq Accession R42447 EP569042, P01584/IL1B_HUMAN Interleukin-1 beta, (SEQ ID NO: 274)
Human interleukin-6 GeneSeq Accession R49041 WO9403492, P05231/IL6_HUMAN Interleukin-6, (SEQ ID NO: 270)
Mutant Interleukin 6 S176R GeneSeq Accession R54990 WO9411402, S176R variant of wildtype IL-6 which has the sequence:, P05231/IL6_HUMAN Interleukin-6, (SEQ ID NO: 270)
Interleukin 6 GeneSeq Accession R55256 JP06145063, P05231/IL6_HUMAN Interleukin-6, (SEQ ID NO: 270)
Interleukin 8 (IL-8) receptor GeneSeq Accession R53932 JP06100595, GenBank: AAA59159.1, (SEQ ID NO: 275)
Human interleukin-7 GeneSeq Accession R59919 U.S. Pat. No. 5,328,988, P13232/IL7_HUMAN Interleukin-7, (isoform 1), (SEQ ID NO: 276)
IL-3 containing fusion protein. GeneSeq Accession R79342 and R79344 WO9521254, Fusions of wildtype IL-3 which has the sequence:, P08700|IL3_HUMAN Interleukin-3, (SEQ ID NO: 449)
IL-3 mutant proteins GeneSeq Accession R79254, R79255, R79256, R79257, R79258, R79259, R79260, R79261, R79262, R79263, R79264, R79265, R79266, R79267, R79268, R79269, R79270, R79271, R79272, R79273, R79274, R79275, R79276, R79277, R79278, R79279, R79280, R79281, R79282, R79283, R79284, and R79285 ZA9402636, Variants of wildtype IL-3 which has the sequence:, P08700|IL3_HUMAN Interleukin-3, (SEQ ID NO: 449)
IL-12 p40 subunit. GeneSeq Accession R63018 AU9466072, P2946/|IL12B_HUMAN Interleukin-12 subunit beta, (SEQ ID NO: 277)
ANGPTL3 Angiopoietin-like 3 GeneSeq Accession EAX06583.1 (SEQ ID NO: 859)
AGF GeneSeq Accession R64240 WO9429344, Q8NI99/ANGL6_HUMAN Angiopoietin-related protein 6, (SEQ ID NO: 278)
Human interlaukin-12 40 kD subunit GeneSeq Accession R79187 WO9519786, P2946/|IL12B_HUMAN Interleukin-12 subunit beta, (SEQ ID NO: 277)
Human interleukin-15 receptor from clone P1 GeneSeq Accession R90843 WO9530695, Q13261|I15RA_HUMAN Interleukin-15 receptor subunit alpha, Isoform 1), (SEQ IDNO: 453)
Human interleukin-7 GeneSeq Accession R92796 WO9604306, P13232/IL7_HUMAN Interleukin-7, (isoform 1), (SEQ ID NO: 276)
interleukin-9 GeneSeq Accession R92797 WO9604306, P15248/IL9_HUMAN Interleukin-9, (SEQ ID NO: 279)
interleukin-3 GeneSeq Accession R92801 WO9604306, P08700|IL3_HUMAN Interleukin-3, (SEQ ID NO: 280)
Human interleukin-5 GeneSeq Accession R92802 WO9604306, P05113/IL5_HUMAN Interleukin-5, (SEQ ID NO: 281)
Recombinant interleukin-16 GeneSeq Accession W33373 DE19617202, Q14005/IL16_HUMAN Pro-interleukin-16, (isoform 1), (SEQ ID NO: 282)
Human IL-16 protein GeneSeq Accession W33234 DE19617202, Q14005/IL16_HUMAN Pro-interleukin-16, (isoform 1), (SEQ ID NO: 282)
Thrl 17 human interleukin 9 GeneSeq Accession W27521 WO9708321, P15248|IL9_HUMAN Interleukin-9, (SEQ ID NO: 387)
Metl 17 human interleukin 9 GeneSeq Accession W27522 WO9708321, (SEQ ID NO: 388)
Human intracellular IL- 1 receptor antagonist. GeneSeq Accession W77158 EP864585 (e.g. SEQ ID NOs: 12 to 19, or 22 to 25 of this publication).
Human interleukin-18 protein (IL-18) GeneSeq Accession W77158 EP864585, Q14116/IL18_HUMAN Interleukin-18, (isoform 1), (SEQ ID NO: 283)
Human interleukin-18 GeneSeq Accession W77077 EP861663, Q14116/IL18_HUMAN Interleukin-18, (isoform 1), (SEQ ID NO: 283)
Human interleukin 18 derivatives GeneSeq Accessions W77083, W77084, W77085, W77086, W77087, W77088, and W77089 EP861663, Variants of wildtype IL18 which is provided as:, Q14116/IL18_HUMAN Interleukin-18, (isoform 1), (SEQ ID NO: 283)

TABLE 2B-continued

Illustrative Proteins and Illustrative Peptides

Protein/Peptide Illustrative Identifier Reference

Interleukin-9 (IL-9) mature protein (Thr117 version). GeneSeq Accession W68158 WO9827997, FIG. 2 of WO9827997, (SEQ ID NO: 389)
IL-9 mature protein variant (Met117 version) GenSeq Accession W68157 WO9827997, FIG. 3 of WO9827997, (SEQ ID NO: 390)
Human IL-9 receptor protein variant #3. GeneSeq Accession W64058 WO9824904, Wildtype IL-9R is provided as:, Q01113/IL9R_HUMAN Interleukin-9 receptor, (isoform 1), (SEQ ID NO: 303)
Human IL-9 receptor protein variant fragment GenSeq Accession W64060 WO9824904, Wildtype IL-9R is provided as:, Q01113/IL9R_HUMAN Interleukin-9 receptor, (isoform 1), (SEQ ID NO: 303)
Human IL-9 receptor protein variant #3. GeneSeq Accession W64061 WO9824904, Wildtype IL-9R is provided as:, Q01113/IL9R_HUMAN Interleukin-9 receptor, (isoform 1), (SEQ ID NO: 303)
Human Interleukin-12 p40 protein GeneSeq Accession W51311 WO9817689, P2946/IL12B_HUMAN Interleukin-12 subunit beta, (SEQ ID NO: 277)
Human Interleukin-12 p35 protein GeneSeq Accession W51312 WO9817689, P29459/IL12A_HUMAN Interleukin-12 subunit alpha, (SEQ ID NO: 284)
Human protein with IL-16 activity GeneSeq Accession W63753 DE19649233-
Human protein with IL-16 activity GeneSeq Accession W59425 DE19649233-
Human interleukin-15 GeneSeq Accession W53878 U.S. Pat. No. 5,747,024, P40933/IL15_HUMAN Interleukin-15, (isoform IL15-S48AA), (SEQ ID NO: 285)
Human wild-type interleukin-4 (hIL-4) protein GeneSeq Accession W52149 WO9747744, P05112/IL4_HUMAN Interleukin-4, (isoform 1), (SEQ ID NO: 286)
interleukin-4 muteins GeneSeq Accessions W52150, W52151, W52153, W52154, W52155, W52156, W52157, W52158, W52159, W52160, W52161, W52162, W52163, W52164, W52165, W52166, and W52167 WO9747744, Variants of wildtype IL-4 which has the sequence:, P05112/IL4_HUMAN Interleukin-4, (isoform 1), (SEQ ID NO: 268)
Human interleukin 1 delta GeneSeq Accession Y28408 WO9935268, SEQ ID NO: 4 of WO9935268, (SEQ ID NO: 287)
Human interleukin-1 receptor antagonist beta GeneSeq Accession Y24395 WO9935268,
Human EDIRF II protein sequence GeneSeq Accession Y22199 WO9932632, SEQ ID NO: 6 of WO9932632, (SEQ ID NO: 391)
Human EDIRF I protein sequence GeneSeq Accession Y22197 WO9932632, SEQ ID NO: 2 of WO9932632, (SEQ ID NO: 392)
Human IL-1RD10 protein sequence GeneSeq Accession Y14131 WO9919480, SEQ ID NO: 20 of WO9919480
Human IL-1RD9 GeneSeq Accession Y14122 WO9919480, SEQ ID NOS: 6, 8, 10 of WO9919480
Human DNAX interleukin-40 GeneSeq Accession Y09196 WO9919491, SEQ ID NO: 2 or 4 of, WO9919491, (SEQ ID NO: 454)
(DIL-40) alternative sequence GeneSeq Accession Y09197 WO9919491, SEQ ID NO: 4 of, WO9919491, (SEQ ID NO: 455)
IL-11 GeneSeq Accession R50176 WO9405318, P2080/IL11_HUMAN Interleukin-11, (isoform 1), (SEQ ID NO: 288)
Human adipogenesis inhibitory factor GeneSeq Accession R43260 EP566410, (also known as IL-11), P2080/IL11_HUMAN Interleukin-11, (isoform 1), (SEQ ID NO: 288)
IL-11 GeneSeq Accession W02202 JP08127539, P2080/IL11_HUMAN Interleukin-11, (isoform 1), (SEQ ID NO: 288)
IL-14 GeneSeq Accession R55800 WO9416074, P40222/TXLNA_HUMAN Alpha-taxilin, (SEQ ID NO: 289)
IL-17 receptor GeneSeq Accession B03807 U.S. Pat. No. 6,072,033, Q96F46/I17RA_HUMAN Interleukin-17 receptor A, (SEQ ID NO: 290)
IL-17 GeneSeq Accession R76573 WO9518826, Q16552/IL17_HUMAN Interleukin-17A, (SEQ ID NO: 291)
CTLA-8 GeneSeq Accession W13651 WO9704097, (also known as IL-17), Q16552/IL17_HUMAN Interleukin-17A, (SEQ ID NO: 291)
IL-19 GeneSeq Accession W37935 WO9808870, Q9UHD0/IL19_HUMAN Interleukin-19, (isoform 1), (SEQ ID NO: 292)
IL-21 (TIF) GeneSeq Accession Y92879 WO0024758, Q9HBE4/IL21_HUMAN Interleukin-21, (isoform 1), (SEQ ID NO: 293)
IL-8 receptor GeneSeq Accession R33420 WO9306229, IL-8RA, P25024/CXCR1_HUMAN C-X-C chemokine receptor type 1, (SEQ ID NO: 294), IL-8RB, P25025/CXCR2_HUMAN C-X-C chemokine receptor type 2, (SEQ ID NO: 295)
Human type II interleukin-1 receptor GeneSeq Accession R85480 U.S. Pat. No. 5,464,937, P27930/IL1R2_HUMAN Interleukin-1 receptor type 2, (SEQ ID NO: 296)
Human interleukin-12 receptor GeneSeq Accession R69632 EP638644, IL-12 receptor B1, P42701/I12R1_HUMAN Interleukin-12 receptor subunit beta-1, (isoform 1), (SEQ ID NO: 393), IL-12 receptor B2, Q99665/I12R2_HUMAN Interleukin-12 receptor subunit beta-2, (isoform 1), (SEQ ID NO: 394)
Interleukin 8 receptor B GeneSeq Accession R80758 U.S. Pat. No. 5,440,021, IL-8RB, P25025/CXCR2_HUMAN C-X-C chemokine receptor type 2, (SEQ ID NO: 295)
Human IL-8 receptor protein hIL8RA GeneSeq Accession B09989 JP08103276, IL-8RA, P25024/CXCR1_HUMAN C-X-C chemokine receptor type 1, (SEQ ID NO: 294)
Human IL-8 receptor protein hIL8R GeneSeq Accession B09990 JP08103276, IL-8RA, P25024/CXCR1_HUMAN C-X-C chemokine receptor type 1, (SEQ ID NO: 294); IL-8RB, P25025/CXCR2_HUMAN C-X-C chemokine receptor type 2, (SEQ ID NO: 295)
Interleukin-2 receptor associated protein p43 GeneSeq Accession R97569 WO9621732-, SEQ ID NO: 2 of WO9621732, (SEQ ID NO: 395)
Human interleukin-17 receptor GeneSeq Accession W04185 WO9629408, Q96F46/I17RA_HUMAN Interleukin-17 receptor A, (SEQ ID NO: 290)
Human interleukin-11 receptor GeneSeq Accession R99090 WO9619574, Q14626/I11RA_HUMAN Interleukin-11 receptor subunit alpha, (SEQ ID NO: 297)
Human interleukin-1 receptor accessory protein GeneSeq Accession W01911 WO9623067, Human IL1R Acp, SEQ ID NO: 3 of WO9623067, (SEQ ID NO: 396); Soluble Human IL1R Acp, SEQ ID NO: 9 of WO9623067, (SEQ ID NO: 397)
AGF Protein GeneSeq Accession R92749 U.S. Pat. No. 5,488,032, Q8NI99/ANGL6_HUMAN Angiopoietin-related protein 6, (SEQ ID NO: 278)
Human interleukin-1 type-3 receptor GeneSeq Accession R91064 WO9607739, SEQ ID NO: 2 and 4 of WO9607739, (SEQ ID NO:398 and SEQ ID NO: 399, respectively)
Human interleukin-13 beta receptor GeneSeq Accession W24972 WO9720926, SEQ ID NO: 2 from WO9720926, (SEQ ID NO: 400)
Human interleukin-13 alpha receptor GeneSeq Accession W24973 WO9720926, IL-13RA1, P78552/I13R1_HUMAN Interleukin-13 receptor subunit alpha-1, (isoform 1), (SEQ ID NO: 298); IL-13RA2, Q14627/I13R2_HUMAN Interleukin-13 receptor subunit alpha-2, (SEQ ID NO: 299)
Human interleukin-4 receptor GeneSeq Accession W13499 U.S. Pat. No. 5,599,905, P24394/IL4RA_HUMAN Interleukin-4 receptor subunit alpha, (isoform 1), (SEQ ID NO: 300)
Human interleukin-12 beta-2 receptor GeneSeq Accession W12771 EP759466, Q9966/I12R2_HUMAN Interleukin-12 receptor subunit beta-2, (isoform 1), (SEQ ID NO: 301)
Human interleukin-12 beta-1 receptor. GeneSeq Accession W12772 EP759466, P4270/I12R1_HUMAN Interleukin-12 receptor subunit beta-1, (isoform 1), (SEQ ID NO: 302)
Human IL-9 receptor protein GeneSeq Accessions W64055, W64056, and W64057 WO9824904, Q01113/IL9R_HUMAN Interleukin-9 receptor, (isoform 1), (SEQ ID NO: 303)

TABLE 2B-continued

Illustrative Proteins and Illustrative Peptides

Protein/Peptide Illustrative Identifier Reference

IL-10 receptor GeneSeq Accession W41804 U.S. Pat. No. 5,716,804, IL-10RA, Q13651/I10R1_HUMAN Interleukin-10 receptor subunit alpha, (SEQ ID NO: 304); IL-10RB, Q0833/|I10R2_HUMAN Interleukin-10 receptor subunit beta, (SEQ ID NO: 305)
Human IL-6 receptor GeneSeq Accession Y30938 JP11196867, P08887/IL6RA_HUMAN Interleukin-6 receptor subunit alpha, (isoform 1), (SEQ ID NO: 306)
Il-17 receptor GeneSeq Accession Y97181 U.S. Pat. No. 6,096,305, Q96F46/I17RA_HUMAN Interleukin-17 receptor A, (SEQ ID NO: 290)
Il-17 receptor GeneSeq Accession Y97131 U.S. Pat. No. 6,100,235, Q96F46/I17RA_HUMAN Interleukin-17 receptor A, (SEQ ID NO: 290)
Human interleukin-3 receptor GeneSeq Accession R25300 EP509826, P26951/IL3RA_HUMAN Interleukin-3 receptor subunit alpha, (isoform 1), (SEQ ID NO: 307)
Human GM- CSF receptor GeneSeq Accession R10919 WO9102063, GM-CSF receptor A, P15509/CSF2R_HUMAN Granulocyte-macrophage colony-stimulating factor receptor subunit alpha, (isoform 1), (SEQ ID NO: 308); GM-CSF receptor B, P32927/IL3RB_HUMAN Cytokine receptor common subunit beta, (isoform 1), (SEQ ID NO: 309)
Human IL-5 receptor alpha chain GeneSeq Accession R25064 EP492214, Q01344/IL5RA_HUMAN Interleukin-5 receptor subunit alpha, (isoform 1), (SEQ ID NO: 310)
Il-5 receptor GeneSeq Accession W82842 WO9847923, Q01344/IL5RA_HUMAN Interleukin-5 receptor subunit alpha, (isoform 1), (SEQ ID NO: 310)
Il-6 receptor GeneSeq Accession R37215 JP05091892, P08887/IL6RA_HUMAN Interleukin-6 receptor subunit alpha, (isoform 1), (SEQ ID NO: 306)
Human B cell stimulating factor-2 receptor GeneSeq Accession P90525 AU8928720, P08887/IL6RA_HUMAN Interleukin-6 receptor subunit alpha, (isoform 1), (SEQ ID NO: 306)
IL-7 receptor clone GeneSeq Accession R08330 EP403114, P1687/IL7RA_HUMAN Interleukin-7 receptor subunit alpha, (isoform 1), (SEQ ID NO: 311)
EPO receptor; EPOR GeneSeq Accession R06512 WO9008822, P19235/EPOR_HUMAN Erythropoietin receptor, (isoform EPOR-F), (SEQ ID NO: 312)
IL-15 receptor GeneSeq Accession R90843 WO9530695, Q1326/|I15RA_HUMAN Interleukin-15 receptor subunit alpha, (isoform 1), (SEQ ID NO: 313)
CD137; 4-1BB Receptor Protein GeneSeq Accession R70977 WO9507984, Q07011/TNR9_HUMAN Tumor necrosis factor receptor superfamily member 9, (SEQ ID NO: 314)
BCMA GeneSeq Accession Y71979 WO0068378, Q02223/TNR17_HUMAN Tumor necrosis factor receptor superfamily member 17, (isoform 1), (SEQ ID NO: 315)
CD27 GeneSeq Accession R20814 WO9201049, P26842/CD27_HUMAN CD27 antigen, (SEQ ID NO: 316)
CD30 GeneSeq Accession R35478 DE4200043, P28908/TNR8_HUMAN Tumor necrosis factor receptor superfamily member 8, (isoform 1), (SEQ ID NO: 317)
CD40 GeneSeq Accession Y33499 WO9945944, P25942/TNR5_HUMAN Tumor necrosis factor receptor superfamily member 5, (isoform 1), (SEQ ID NO: 318)
EDAR Genbank Accession AAD50077, Q9UNE0|EDAR_HUMAN Tumor necrosis factor receptor superfamily member EDAR, (isoform 1), (SEQ ID NO: 319)
OX40; ACT-4 GeneSeq Accession R74737 WO9512673, P43489/TNR4_HUMAN Tumor necrosis factor receptor superfamily member 4, (SEQ ID NO: 320)
TACI GeneSeq Accession W75783 WO9839361, O14836/TR13B_HUMAN Tumor necrosis factor receptor superfamily member 13B, (isoform 1), (SEQ ID NO: 321)
TNF-R GeneSeq Accession R10986 AU9058976, P19438/TNR1A_HUMAN Tumor necrosis factor receptor superfamily member 1A, (isoform 1), (SEQ ID NO: 322)
TNF-RII; TNF p75 receptor; Death Receptor GeneSeq Accession R11141 EP418014, P20333/TNR1B_HUMAN Tumor necrosis factor receptor superfamily member 1B, (isoform 1), (SEQ ID NO: 323)
hAPO-4; TROY GeneSeq Accession W93581 WO9911791, Q9NS68/TNR19_HUMAN Tumor necrosis factor receptor superfamily member 19, (isoform 1), (SEQ ID NO: 324)
TNF-alpha precursor GeneSeq Accession P60074 EP205038
Human TNF- alpha GeneSeq Accession R62463 EP619372, P01375/TNFA_HUMAN Tumor necrosis factor, (SEQ ID NO: 325)
Human TNF- alpha GeneSeq Accession R42679 EP563714, P01375/TNFA_HUMAN Tumor necrosis factor, (SEQ ID NO: 325)
Human TNF- beta (LT-alpha) GeneSeq Accession B37799 WO0064479, P01374/TNFB_HUMAN Lymphotoxin-alpha, (SEQ ID NO: 326)
LT-alpha GeneSeq Accession P70107 EP250000, P01374/TNFB_HUMAN Lymphotoxin-alpha, (SEQ ID NO: 326)
LT-beta GeneSeq Accession R56869 WO9413808, Q06643/TNFC_HUMAN Lymphotoxin-beta, (isoform 1), (SEQ ID NO: 327)
OPGL GeneSeq Accession W83195 WO9846751, O14788/TNF11_HUMAN Tumor necrosis factor ligand superfamily member 11, (isoform 1), (SEQ ID NO: 328)
FasL GeneSeq Accession W98071 WO9903999, P48023/TNFL6_HUMAN Tumor necrosis factor ligand superfamily member 6, (isoform 1), (SEQ ID NO: 329)
FasL GeneSeq Accession W95041 WO9903998, P48023/TNFL6_HUMAN Tumor necrosis factor ligand superfamily member 6, (isoform 1), (SEQ ID NO: 329)
CD27L GeneSeq Accession R50121 WO9405691, P32970/CD70_HUMAN CD70 antigen, (isoform 1), (SEQ ID NO: 330)
CD30 ligand GeneSeq Accession R45007 WO9324135, P32971/TNFL8_HUMAN Tumor necrosis factor ligand superfamily member 8, (SEQ ID NO: 331)
CD40L GeneSeq Accession R85486 WO9529935, P29965/CD40L_HUMAN CD40 ligand, (SEQ ID NO: 332)
4-1BB ligand GeneSeq Accession W26657 U.S. Pat. No. 5,674,704, P41273/TNFL9_HUMAN Tumor necrosis factor ligand superfamily member 9, (SEQ ID NO: 333)
FAS Ligand Inhibitory Protein (DcR3) GeneSeq Accession B19335 WO0058465, O95407/TNF6B_HUMAN Tumor necrosis factor receptor superfamily member 6B, (SEQ ID NO: 334)
OX40L GeneSeq Accession R79903 WO9521915, P23510/TNFL4_HUMAN Tumor necrosis factor ligand superfamily member 4, (isoform 1), (SEQ ID NO: 335)
Protease inhibitor peptides GeneSeq Accessions R12435, R12436, R12437, R12438, R12439, R12440, and R1244 WO9106561
Retroviral protease inhibitors GeneSeq Accessions R06660, R06661, R06662, R06663, R06664, R06665, R06666, R06667, R06668, R06669, R06670, R06671, R06672, R06673, R06674, R06675, and R06676 EP387231
HIV protease inhibiting peptides GeneSeq Accessions R59293, R59294, R59295, R59296, R59297, R59298, R59299, R592300, R59301, R59302, R59301, R59302, R59303, R59304, R59305, R59306, R59307, R59308, R59309, R59310, R59311, R59312, R59313, R59314, R59315, R59316, R59317 R59318, R59319, R59320, R59321, R59322, R59323, R59324, R59325, R59326, R59327, R59328, R59329, R59330, R59331, R59332, R59333, R59334, R59335, R59336, R59337, R59338, R59339, R59340, R59341, R59342, R59343, R59344, R59345, R59346, R59347, R59348, R59349, and R59350 WO9301828

TABLE 2B-continued

Illustrative Proteins and Illustrative Peptides

Protein/Peptide Illustrative Identifier Reference

HIV-1 protease inhibitors GeneSeq Accessions R86326, R86327, R86328, R86329, R86330, R86331, R86332, R86333, R86334, R86335, R86336, R86337, R86338, R86339, R86340, R86341, R86342, R86343, R86344, R86345, R86346, R86347, R86348, R86349, R86350, R86351, R86352, R86353, R86354, R86355, R86356, R86357, R86358, R86359, R86360, R86361, R86362, R86363, R86364, R86365, R86366, R86367, R86368, R86369, R86370, and R86371 DE4412174
HIV Inhibitor Peptide GeneSeq Accession Y89687 WO9959615
HIV Inhibitor Peptide GenSeq Accession Y31955 WO9948513
HIV Inhibitor Peptide Science 291, 884 (2001); Published online 12 Jan. 2001; 10.1126/science.1 057453
Human monocyte chemoattractant factor hMCP-3 GeneSeq Accession R73915 WO9509232, P80098/CCL7_HUMAN C-C motif chemokine 7, (SEQ ID NO: 336)
Human monocyte chemoattractant factor hMCP-1 GeneSeq Accession R73914 WO9509232, P13500/CCL2_HUMAN C-C motif chemokine 2, (SEQ ID NO: 337)
Human gro-beta chemokine GeneSeq Accessions R66699 and W17671 WO9429341, P19875/CXCL2_HUMAN C-X-C motif chemokine 2, (SEQ ID NO: 338)
Human gro-gamma chemokine GeneSeq Accessions R66700 and W17672 WO9429341, P19876/CXCL3_HUMAN C-X-C motif chemokine 3, (SEQ ID NO: 339)
Human gro-alpha chemokine GeneSeq Accessions R66698 and W18024 WO9429341, P09341/GROA_HUMAN Growth-regulated alpha protein, (SEQ ID NO: 340)
Human eosinophil- expressed chemokine (EEC) GeneSeq Accession W05186 WO9632481, SEQ ID NO: 2 of WO9632481, (SEQ ID NO: 401)
Chemokine-like protein PF4-414 Full-Length and Mature GeneSeq Accessions R92318 and R99809 WO9613587, FIG. 3C of WO9613587, (SEQ ID NO: 402)
Chemokine-like protein IL-8M3 GeneSeq Accession R99812 WO9613587
Human interleukin-8 (IL-8) GeneSeq Accession R99814 WO9613587, P10145/IL8_HUMAN Interleukin-8, (isoform 1), (SEQ ID NO: 341)
Chemokine-like protein IL-8M1 Full-Length and Mature GeneSeq Accessions R99815 and R99803 WO9613587, FIG. 4B of WO9613587, (SEQ ID NO: 403)
Chemokine-like protein IL-8M8 Full-Length and Mature GeneSeq Accessions R99816 and R99805 WO9613587, FIG. 4C of WO9613587, (SEQ ID NO: 404)
Chemokine-like protein IL-8M8 Full-Length and Mature GeneSeq Accessions R99817 and R99806 WO9613587, FIG. 4C of WO9613587, (SEQ ID NO: 404)
Chemokine-like protein IL-8M8 Full-Length and Mature GeneSeq Accessions R99818 and R99804 WO9613587, FIG. 4C of WO9613587, (SEQ ID NO: 404)
Chemokine-like protein IL-8M8 Full-Length and Mature GeneSeq Accessions R99819 and R99807 WO9613587, FIG. 4C of WO9613587, (SEQ ID NO: 404)
Chemokine-like protein IL-8M8 Full-Length and Mature GeneSeq Accessions R99822 and R9807 WO9613587, FIG. 4C of WO9613587, (SEQ ID NO: 404)
Human foetal spleen ex- pressed chemo-kine, FSEC GeneSeq Accession R98499 WO9622374, SEQ ID NO: 2 of, WO9622374, (SEQ ID NO: 405)
Liver expressed chemokine- 1(LVEC-1) GeneSeq Accession R95689 WO9616979, SEQ ID NO: 2 of, WO9616979, (SEQ ID NO: 406)
Liver expressed chemokine- 2(LVEC-2) GeneSeq Accession R95690 WO9616979, SEQ ID NO: 4 of, WO9616979, (SEQ ID NO: 407)
Pituitary expressed chemokine (PGEC) GeneSeq Accession R95691 WO9616979, SEQ ID NO: 6 of, WO9616979, (SEQ ID NO: 408)
Adenoid- expressed chemokine (ADEC) GeneSeq Accession R97664 WO9617868, SEQ ID NO: 2 of, WO9617868, (SEQ ID NO: 409)
Human chemokine CC-2 GeneSeq Accession W38170 WO9741230, Q16663/CCL15_HUMAN C-C motif chemokine 15, (SEQ ID NO: 342)
Human chemokine HCC-1 GeneSeq Accession W38171 WO9741230, Q16627/CCL14_HUMAN C-C motif chemokine 14, (SEQ ID NO: 343)
Human chemokine CC- 3 GeneSeq Accession W38172 WO9741230, Q16627/CCL14_HUMAN C-C motif chemokine 14, (SEQ ID NO: 343)
Novel betachemokine designated PTEC GeneSeq Accession W27271 WO9739126, SEQ ID NO: 2 of WO9739126, (SEQ ID NO: 410)
Human CX3C 111 amino acid chemokine GeneSeq Accession W23344 WO9727299, SEQ ID NO: 2 of WO9727299, (SEQ ID NO: 411)
Human CCF18 chemokine GeneSeq Accession W25942 WO9721812, SEQ ID NO: 4 of WO9721812, (SEQ ID NO: 412)
Human beta- chemokine H1305 (MCP-2) GeneSeq Accession W26655 WO9725427, P80075/CCL8_HUMAN C-C motif chemokine 8, (SEQ ID NO: 344)
Human eosinocyte CC type chemokine eotaxin GeneSeq Accession W14990 WO9712914, P51671/CCL11_HUMAN Eotaxin, (SEQ ID NO: 245)
Human thymus and activation regulated cytokine (TARC) GeneSeq Accession W14018 WO9711969, Q92583/CCL17_HUMAN C-C motif chemokine 17, (SEQ ID NO: 261)
Human chemokine beta-8 short forms GeneSeq Accession W16315 WO9712041, Wildtype chemokine beta-8 provided as:, P55773|CCL23_HUMAN C-C motif chemokine 23, (SEQ ID NO: 459)
Microphage derived chemokine, MDC GeneSeq Accession W20058 WO9640923, O00626/CCL22_HUMAN C-C motif chemokine 22, (SEQ ID NO: 345)
Human chemokine ZSIG-35 GeneSeq Accession W30565 WO9844117, SEQ ID NO: 2 of WO WO9844117, (SEQ ID NO: 413)
Primate CC chemokine "ILINCK" GeneSeq Accesssion W69990 WO98328658, SEQ ID NO: 4 from WO9832858, (SEQ ID NO: 414)
Primate CXC chemokine "IBICK" GeneSeq Accession W69989 WO9832858, SEQ ID NO: 2 from WO9832858, (SEQ ID NO: 415)
Human CC-type chemokine protein designated SLC (secondary lymphoid chemokine) GeneSeq Accession W69163 WO9831809, O00585/CCL21_HUMAN C-C motif chemokine 21, (SEQ ID NO: 346)
Human CC chemokine ELC protein GeneSeq Accession W62542 WO9826071, Q99731/CCL19_HUMAN C-C motif chemokine 19, (SEQ ID NO: 249)
Human DVic-1 C-C chemokine GeneSeq Accession W60649 WO9823750, SEQ ID NO: 2 of WO9823750, (SEQ ID NO: 416)
Human C-C chemokine DGWCC GeneSeq Accession W60650 WO9823750, SEQ ID NO: 6 of WO9823750, (SEQ ID NO: 417)
Human STCP-1 GeneSeq Accession W62783 WO9824907, O00626/CCL22_HUMAN C-C motif chemokine 22, (SEQ ID NO: 345)
Exodus protein GeneSeq Accession W61279 WO9821330, P78556/CCL20_HUMAN C-C motif chemokine 20, (isoform 1), (SEQ ID NO: 248)
Human Chr19kine protein GeneSeq Accession W50887 WO9814581, SEQ ID NO: 10 of WO9814581, (SEQ ID NO: 418)
Human T cell mixed lymphocyte reaction expressed chemokine (TMEC) GeneSeq Accession W58703 U.S. Pat. No. 5,780,268, SEQ ID NO: 2 of U.S. Pat. No. 5,780,268, (SEQ ID NO: 460)

TABLE 2B-continued

Illustrative Proteins and Illustrative Peptides

Protein/Peptide Illustrative Identifier Reference

Human 6CKine protein GeneSeq Accession W50885 WO9814581, SEQ ID NO: 8 of WO9814581, (SEQ ID NO: 419)
human liver and activation regulated chemokine (LARC) GeneSeq Accession W57475 WO9817800, P78556/CCL20_HUMAN C-C motif chemokine 20, (isoform 1), (SEQ ID NO: 248)
RANTES peptide GeneSeq Accession W29538 WO9744462, Wildtype Rantes provided herien as P13501/CCL5_HUMAN C-C motif chemokine 5, (SEQ ID NO: 241)
RANTES 8-68 GeneSeq Accession W29529 WO9744462, Wildtype Rantes provided herien as P13501/CCL5_HUMAN C-C motif chemokine 5, (SEQ ID NO: 241)
RANTES 9-68 GeneSeq Accession W29528 WO9744462, Wildtype Rantes provided herien as P13501/CCL5_HUMAN C-C motif chemokine 5, (SEQ ID NO: 241)
Human chemokine protein 331D5 GeneSeq Accession W59433 WO9811226, SEQ ID NO: 12 of WO9811226, (SEQ ID NO: 420)
Human chemokine protein 61164 GeneSeq Accession W59430 WO9811226, SEQ ID NO: 6 of WO9811226, (SEQ ID NO: 421)
Chemokine MCP-4 GeneSeq Accession W56690 WO9809171, Q99616/CCL13_HUMAN C-C motif chemokine 13, (SEQ ID NO: 347)
Human stromal cell-derived chemokine, SDF-1 GeneSeq Accession W50766 FR2751658, P48061/SDF1_HUMAN Stromal cell-derived factor 1, (isoform beta), (SEQ ID factor 1, (isoform beta), (SEQ ID NO: 260)
Thymus expressed chemokine (TECK) GeneSeq Accession W44397 WO9801557, O15444/CCL25_HUMAN C-C motif chemokine 25, (SEQ ID NO: 348)
Human chemokine MIP-3alpha GeneSeq Accession W44398 WO9801557, P78556/CCL20_HUMAN C-C motif chemokine 20, (isoform 1), (SEQ ID NO: 248)
Human chemokine MIP-3beta GeneSeq Accession W44399 WO9801557, Q99731/CCL19_HUMAN C-C motif chemokine 19, (SEQ ID NO: 249)
Human monocyte chemotactic proprotein (MCPP) sequence GeneSeq Accession W42072 WO9802459, SEQ ID NO: 1 of WO9802459, (SEQ ID NO: 456)
Macrophage- derived chemokine (MDC) GeneSeq Accessions W40811 and Y24414 U.S. Pat. No. 5,688,927/U.S. Pat. No. 5,932,703, O00626/CCL22_HUMAN C-C motif chemokine 22, (SEQ ID NO: 345)
Macrophage derived chemokine analogue MDC-eyfy GeneSeq Accession Y24416 U.S. Pat. No. 5,932,703 ("eyfy" disclosed as SEQ ID NO: 546), Wildtype MDC is SEQ ID NO: 2 of 5,932,703, (SEQ ID NO: 422)
Macrophage derived chemokine analogue MDC (n + 1) GeneSeq Accession Y24413 U.S. Pat. No. 5,932,703
Macrophage derived chemokine analogue MDC-yl GeneSeq Accession Y24415 U.S. Pat. No. 5,932,703
Human type CC chemokine eotaxin 3 protein sequence GeneSeq Accession Y43178 JP11243960, Q9Y258/CCL26_HUMAN C-C motif chemokine 26, (SEQ ID NO: 349)
Human MCP-3 and human Muc-1 core epitope (VNT) fusion protein GeneSeq Acession Y29893 WO9946392, Wildtype MCP-3 has the sequence:, P80098/CCL7_HUMAN C-C motif chemokine 7, (SEQ ID NO: 336); Wildtype Muc-1 has the sequence:, P15941|MUC1_HUMAN Mucin-1, (isoform 1), (SEQ ID NO: 461)
Human IP-10 and human Muc-1 core epitope (VNT) fusion protein GeneSeq Accession Y29894 WO9946392, Wildtype IP10 has the sequence:, P02778/CXL10_HUMAN C-X- C motif chemokine 10, (SEQ ID NO: 242); Wildtype Muc-1 has the sequence:, P15941|MUC1_HUMAN Mucin-1, (isoform 1), (SEQ ID NO: 461)
Human IP-10 and HIV-1 gp 120 hyper- variable region fusion protein GeneSeq Accession Y29897 WO9946392, Wildtype IP10 has the sequence:, P02778/CXL10_HUMAN C-X-C motif chemokine 10, (SEQ ID NO: 242); Wildtype gp120 has the sequence:, P03378|32-509, (cleaved product of gp160), (SEQ ID NO: 462)
Human mammary associated chemokine (MACK) protein Full-Length and Mature GeneSeq Accessions Y29092 and Y29093 WO9936540, Full-length: SEQ ID NO: 1 of WO9936540, (SEQ ID NO: 423); Mature Form: SEQ ID NO: 2 of WO9936540, (SEQ ID NO: 424)
Tim-1 protein GeneSeq Accession Y28290 WO9933990, SEQ ID NO: 2 of, WO9933990, (SEQ ID NO: 350)
Human Lkn-1 Full-Length and Mature protein GeneSeq Accessions Y17280, Y17274, Y17281, and Y17275 WO9928473 and WO9928472, Q16663/CCL15_HUMAN C-C motif chemokine 15, (SEQ ID NO: 342)
N-terminal modified chemokine met- hSDF-1 alpha GeneSeq Accession Y05818 WO9920759, SEQ ID NO: 10 of WO9920759, (SEQ ID NO: 425)
N-terminal modified chemokine met- hSDF-1 beta GeneSeq Accession Y05819 WO9920759, SEQ ID NO: 11 of WO9920759, (SEQ ID NO: 426)
N-terminal modified chemokine GroHEK/hSDF- 1alpha GeneSeq Accession Y05820 WO9920759, SEQ ID NO: 12 of WO9920759, (SEQ ID NO: 427)
N-terminal modified chemokine GroHEK/hSDF- 1beta. GeneSeq Accession Y05821 WO9920759, SEQ ID NO: 13 of WO9920759, (SEQ ID NO: 428)
Chemokine Eotaxin GeneSeq Accession Y14230 WO9912968, P51671/CCL11_HUMAN Eotaxin, (SEQ ID NO: 245)
Chemokine hMCP1a GeneSeq Accession Y14225 WO9912968
Chemokine hMCP1b GeneSeq Accession Y14226 WO9912968
Chemokine hSDF1b GeneSeq Accession Y14228 WO9912968, P48061/SDF1_HUMAN Stromal cell-derived factor 1, (isoform beta), (SEQ ID NO: 260)
Chemokine hIL-8 GeneSeq Accession Y14229 WO9912968, P10145/IL8_HUMAN Interleukin-8, (isoform 1), (SEQ ID NO: 341)
Chemokine hMCP1 GeneSeq Accession Y14222 WO9912968, P13500/CCL2_HUMAN C-C motif chemokine 2, (SEQ ID NO: 337)
Chemokine hMCP2 GeneSeq Accession Y14223 WO9912968, P80075/CCL8_HUMAN C-C motif chemokine 8, (SEQ ID NO: 344)
Chemokine hMCP3 GeneSeq Accession Y14224 WO9912968, P80098/CCL7_HUMAN C-C motif chemokine 7, (SEQ ID NO: 336)
C-C chemokine, MCP2 GeneSeq Accession Y05300 EP905240, P80075/CCL8_HUMAN C-C motif chemokine 8, (SEQ ID NO: 344)
Wild type monocyte chemotactic protein 2 GeneSeq Accession Y07233 EP906954, P80075/CCL8_HUMAN C-C motif chemokine 8, (SEQ ID NO: 344)
Truncated monocyte chemotactic protein 2 (6-76) GeneSeq Accession Y07234 EP906954, FIG. 1 of EP905241 and EP906954, (SEQ ID NO: 429)
Truncated RANTES protein (3-68) GeneSeq Accessions Y07236 and Y07232 EP905241; EP906954, FIG. 1 of EP906954, (SEQ ID NO: 430)
Wild type monocyte chemotactic protein 2 GeneSeq Accession Y07237 EP905241, P80075/CCL8_HUMAN C-C motif chemokine 8, (SEQ ID NO: 344)
Truncated monocyte chemotactic protein 2 (6-76) GeneSeq Accession Y07238 EP905241, FIG. 1 of EP905241 and EP906954, (SEQ ID NO: 429)
A partial CXCR4B protein GeneSeq Accession W97363 EP897980, SEQ ID NO: 2 of EP897980, (SEQ ID NO: 431)
Interferon gamma- inducible protein (IP-10) GeneSeq Accession W96709 U.S. Pat. No. 5,871,723, P02778/CXL10_HUMAN C-X-C motif chemokine 10, (SEQ ID NO: 242)

TABLE 2B-continued

Illustrative Proteins and Illustrative Peptides

Protein/Peptide Illustrative Identifier Reference

A monokine induced by gamma- interferon (MIG) GeneSeq Accession W96710 U.S. Pat. No. 5,871,723, Q07325/CXCL9_HUMAN C-X-C motif chemokine 9, (SEQ ID NO: 351)
Interleukin-8 (IL-8) protein. GeneSeq Accession W96711 U.S. Pat. No. 5,871,723, P10145/IL8_HUMAN Interleukin-8, (isoform 1), (SEQ ID NO: 341)
Epithelial neutrophil activating protein-78 (ENA-78) GeneSeq Accession W96712 U.S. Pat. No. 5,871,723, P42830/CXCL5_HUMAN C-X-C motif chemokine 5, (SEQ ID NO: 352)
Growth related oncogene-alpha (GRO-alpha). GeneSeq Accession W96713 U.S. Pat. No. 5,871,723, P09341/GROA_HUMAN Growth-regulated alpha protein, (SEQ ID NO: 340)
Growth related oncogene-beta (GRO-beta). GeneSeq Accession W96714 U.S. Pat. No. 5,871,723, P19875/CXCL2_HUMAN C-X-C motif chemokine 2, (SEQ ID NO: 338)
Growth related oncogene- gamma (GRO-gamma) GeneSeq Accession W96715 U.S. Pat. No. 5,871,723, P19876/CXCL3_HUMAN C-X-C motif chemokine 3, (SEQ ID NO: 339)
A platelet basic protein (PBP) GeneSeq Accession W96716 U.S. Pat. No. 5,871,723, P02775/CXCL7_HUMAN Platelet basic protein, (SEQ ID NO: 353)
Connective tissue activating protein-III (CTAP-III) GeneSeqAc- cession S96717 U.S. Pat. No. 5,871,723, SEQ ID NO: 9 of U.S. Pat. No. 5,871,723, (SEQ ID NO: 354)
Beta-thrombo- globulin protein (beta-TG) GeneSeq Accession W96718 U.S. Pat. No. 5,871,723, SEQ ID NO: 10 of U.S. Pat. No. 5,871,723, (SEQ ID NO: 355)
Neutrophil activating peptide-2 (NAP-2) GeneSeq Accession W96719 U.S. Pat. No. 5,871,723, SEQ ID NO: 11 of U.S. Pat. No. 5,871,723, (SEQ ID NO: 356)
Granulocyte chemotactic protein-2 (GCP-2) GeneSeq Accession W96720 U.S. Pat. No. 5,871,723, P80162/CXCL6_HUMAN C-X-C motif chemokine 6, (SEQ ID NO: 357)
Human chemokine MIG-beta protein GeneSeq Accession W90124 EP887409, (SEQ ID NO: 463)
Human ZCHEMO-8 GeneSeq Accession W82716 WO9854326, SEQ ID NO: 2 of WO9854326, (SEQ ID NO: 432)
Human Act-2 protein GeneSeq Accession W82717 WO9854326, P13236/CCL4_HUMAN C-C motif chemokine 4, (SEQ ID NO: 358)
Human SISD protein GeneSeq Accession W82720 WO9854326, P13501/CCL5_HUMAN C-C motif chemokine 5, (SEQ ID NO: 241)
Human MI10 protein GeneSeq Accession W82721 WO9854326, SEQ ID NO: 37 of WO9854326, (SEQ ID NO: 433)
Human MI1A protein GeneSeq Accession W82722 WO9854326, SEQ ID NO: 38 of WO9854326, (SEQ ID NO: 434)
Human CCC3 protein GeneSeq Accession W82723 WO9854326, SEQ ID NO: 39 of WO9854326, (SEQ ID NO: 435)
A human L105 chemokine designated huL105_3. GeneSeq Accession W87588 WO9856818, SEQ ID NO: 2 of WO9856818, (SEQ ID NO: 436)
A human L105 chemokine designated huL105_7. GeneSeq Accession W87589 WO9856818, SEQ ID NO: 4 of WO9856818, (SEQ ID NO: 437)
Human mature gro-alpha polypeptide used to treat sepsis GeneSeq Accession W81498 WO9848828, P09341/GROA_HUMAN Growth-regulated alpha protein, (SEQ ID NO: 340)
Human mature gro-gamma polypeptide used to treat sepsis GeneSeq Accession W81500 WO9848828, P19876/CXCL3_HUMAN C-X-C motif chemokine 3, (SEQ ID NO: 339)
Human thymus expressed chemokine TECK and TECK variant GeneSeq Accessions B19607 and B19608 WO0053635, Wildtype TECKprovided as:, O15444/CCL25_HUMAN C-C motif chemokine 25, (SEQ ID NO: 348)
Human chemokine SDF1alpha GeneSeq Accession B15791 WO0042071, P48061-2/SDF1_HUMAN Isoform Alpha of Stromal cell-derived factor 1, (isoform alpha), (SEQ ID NO: 259),
Human chemokine GRO-alpha GeneSeq Accession B15793 WO0042071, P09341/GROA_HUMAN Growth-regulated alpha protein, (SEQ ID NO: 340)
Human chemokine eotaxin GeneSeq Accession B15794 WO0042071, P51671/CCL11_HUMAN Eotaxin, (SEQ ID NO: 245)
Human chemokine MIG GeneSeq Accession B15803 WO0042071, Q07325/CXCL9_HUMAN C-X-C motif chemokine 9, (SEQ ID NO: 351)
Human chemokine PF4 GeneSeq Accession B15804 WO0042071, P02776/PLF4_HUMAN Platelet factor 4, (SEQ ID NO: 359)
Human chemokine I- 309 GeneSeq Accession B15805 WO0042071, P22362/CCL1_HUMAN C-C motif chemokine 1, (SEQ ID NO: 360)
Human chemokine HCC-1 GeneSeq Accession B15806 WO0042071, Q16627/CCL14_HUMAN C-C motif chemokine 14, (SEQ ID NO: 361)
Human chemokine C10 GeneSeq Accession B15807 WO0042071, SEQ ID NO: 49 of WO0042071, (SEQ ID NO: 438)
Human chemokine CCR-2 GeneSeq Accession B15808 WO0042071, P41597/CCR2_HUMAN C-C chemokine receptor type 2, (isoform A), (SEQ ID NO: 362)
Human chemokine ENA-78 GeneSeq Accession B15809 WO0042071, P42830/CXCL5_HUMAN C-X-C motif chemokine 5, (SEQ ID NO: 352)
Human chemokine GRObeta GeneSeq Accession B15810 WO0042071, P19875/CXCL2_HUMAN C-X-C motif chemokine 2, (SEQ ID NO: 338)
Human chemokine IP-10 GeneSeq Accession B15811 WO0042071, P02778/CXL10_HUMAN C-X-C motif chemokine 10, (SEQ ID NO: 242)
Human chemokine SDF1beta GeneSeq Accession B15812 WO0042071, P48061/SDF1_HUMAN Stromal cell-derived factor 1, (isoform beta), (SEQ ID NO: 260)
Human chemokine GRO alpha GeneSeq Accession B15813 WO0042071, P09341/GROA_HUMAN Growth-regulated alpha protein, (SEQ ID NO: 340),
Human chemokine MIP1beta GeneSeq Accession B15831 WO0042071, P13236/CCL4_HUMAN C-C motif chemokine 4, (SEQ ID NO: 358)
A human C-C chemokine designated exodus GeneSeq Accession B07939 U.S. Pat. No. 6,096,300, P78556/CCL20_HUMAN C-C motif chemokine 20, (isoform 1), (SEQ ID NO: 248)
Human chemokine L105_7 GeneSeq Accession Y96922 U.S. Pat. No. 6,084,071, SEQ ID NO: 4 of WO9856818, (SEQ ID NO: 437)
Human chemokine L105_3 GeneSeq Accession Y96923 U.S. Pat. No. 6,084,071, SEQ ID NO: 2 of WO9856818, (SEQ ID NO: 436)
Human secondary lymphoid chemokine (SLC) GeneSeq Accession B01434 WO0038706, O00585/CCL21_HUMAN C-C motif chemokine 21, (SEQ ID NO: 346)
Human non- ELR CXC chemokine H174 GeneSeq Accession Y96310 WO0029439, O14625/CXL11_HUMAN C-X-C motif chemokine 11, (SEQ ID NO: 363)
Human non- ELR CXC chemokine IP10 GeneSeq Accession Y96311 WO0029439, P02778/CXL10_HUMAN C-X-C motif chemokine 10, (SEQ ID NO: 242)

TABLE 2B-continued

Illustrative Proteins and Illustrative Peptides

Protein/Peptide Illustrative Identifier Reference

Figure 1:
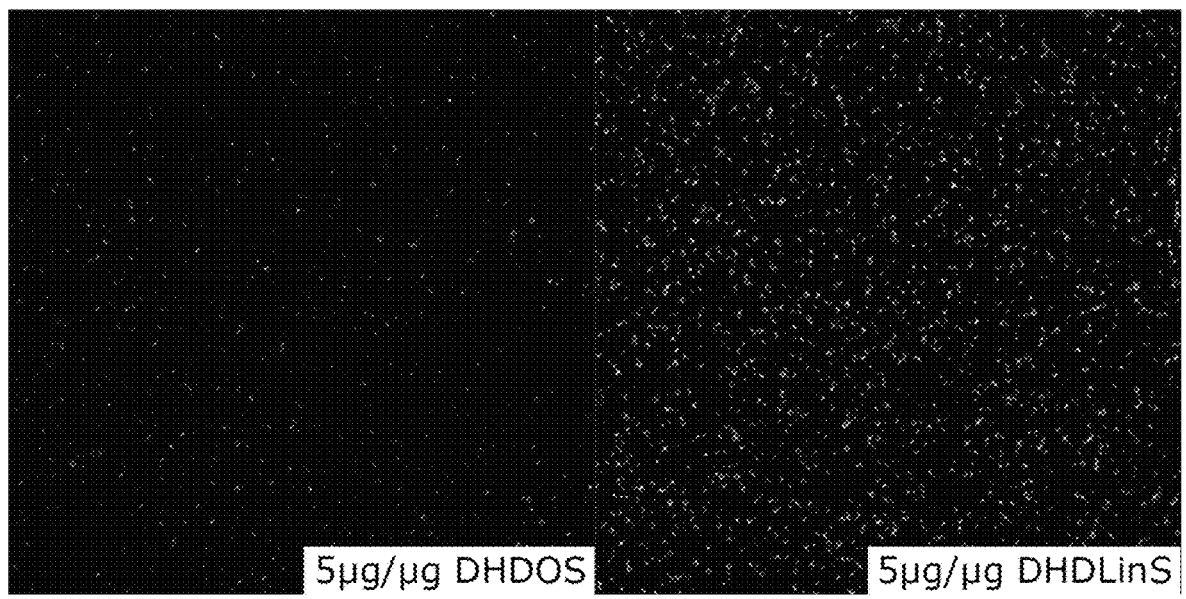

Human non- ELR CXC chemokine Mig GeneSeq Accession Y96313 WO0029439, Q07325/CXCL9_HUMAN C-X-C motif chemokine 9, (SEQ ID NO: 351)
Human chemokine Ckbeta-7 GeneSeq Accession Y96280 WO0028035, FIG.1 of WO0028035, (SEQ ID NO: 439)
Human chemokine MIP-1alpha GeneSeq Accession Y96281 WO0028035, P10147/CCL3_HUMAN C-C motif chemokine 3, (SEQ ID NO: 364)
Human mature chemokine Ckbeta-7 (optionally truncated) GenSeq Accession Y96282 WO0028035, FIG. 1 of WO0028035, (SEQ ID NO: 440)
Human chemokine receptor CXCR3 GeneSeq Accession Y79372 WO0018431, P49682|CXCR3_HUMAN C-X-C chemokine receptor type 3, (isoform 1), (SEQ ID NO: 240)
Human neurotactin chemokine like domain GeneSeq Accession Y53259 U.S. Pat. No. 6,043,086, P78423/X3CL1_HUMAN Fractalkine, (SEQ ID NO: 244)
Human CC type chemokine interleukin C GeneSeq Accession Y57771 JP11302298
Human CKbeta- 9 GeneSeq Accession B50860 U.S. Pat. No. 6,153,441, O00585/CCL21_HUMAN C-C motif chemokine 21, (SEQ ID NO: 346)
Preproapolipo- protein "paris" variant GeneSeq Accession W08602 WO9637608, (SEQ ID NO: 466)
Preproapolipo- protein "milano" variant 5,721,114, SEQ ID NO: 6 of U.S. Pat. No. 5,721,114, (SEQ ID NO: 441)
Glycodelin-A; Progesterone- associated endometrial protein GeneSeq Accession W00289 WO9628169, P09466/PAEP_HUMAN Glycodelin, (SEQ ID NO: 365)
NOGO-A Genbank Accession CAB99248, (SEQ ID NO: 366)
NOGO-B Genbank Accession CAB99249, (SEQ ID NO: 367)
NOGO-C Genbank Accession CAB99250, (SEQ ID NO: 368),
NOGO-66 Receptor Genbank Accession AAG53612, (SEQ ID NO: 369)
Antibodies specific for collapsin U.S Pat. No. 5,416,197, Wildtype collapsin has the sequence:, SEQ ID NO: 2 of 5,416,197, (SEQ ID NO: 464)
Humanized Anti-VEGF Antibodies, and fragments thereof WO9845331
Humanized Anti-VEGF Antibodies, and fragments thereof WO0029584
Membrane bound proteins GeneSeq. Accession Y66631-Y66765 WO9963088
Secreted and Transmembrane polypeptides GeneSeq Accession B44241-B44334 WO0053756
Secreted and Transmembrane polypeptides GeneSeq Accession Y41685-Y41774 WO9946281
Interleukin 2 (IL-2), (SEQ ID NO: 548)
Interleukin 15_vA, (IL-15_vA), (SEQ ID NO: 549)
Interleukin 15_vB, (IL-15_vB), (SEQ ID NO: 550)
Interleukin 15_vC, (IL-15_vC), (SEQ ID NO: 551)
Interleukin 15_vD, (IL15_vD), (SEQ ID NO: 552)
Interleukin 15_vE, (IL15_vE), (SEQ ID NO: 553)
Interleukin 15_vF, (IL15_vF), (SEQ ID NO: 565)
Interleukin 22, (IL22), (SEQ ID NO: 554)
Fibroblast Growth Factor 1 (FGF1), (SEQ ID NO: 555)
Fibroblast Growth Factor 1_vA, (FGF1_vA), (SEQ ID NO: 556)
Fibroblast Growth Factor 1_vB, (FGF1_vB), (SEQ ID NO: 557)
Fibroblast Growth Factor 1_vC, (FGF1_vC), (SEQ ID NO: 566)
Fibroblast Growth Factor 19_vA, (FGF19_vA), (SEQ ID NO: 558)
Fibroblast Growth Factor 21, (FGF21), (SEQ ID NO: 559)
Fibroblast Growth Factor 23, (FGF23), (SEQ ID NO: 560)
Brain-Derived Neurotrophic Factor (BDNF), (SEQ ID NO: 561)
Serpin Family A Member 1, (SERPINA1), ((SEQ ID NO: 584) and ((SEQ ID NO: 585)
Serpin Peptidase Inhibitor, Clade B (Ovalbumin), Member 1, (SERPINB1), (SEQ ID NO: 562)
CASPASE1, (SEQ ID NO: 563)
Leukemia Inhibitory Factor, (LIF), (SEQ ID NO: 564)
Proprotein Convertase Subtilisin/Kexin Type 1, (PCSK1), (SEQ ID NO: 567)
Proprotein Convertase Subtilisin/Kexin Type 2 (PCSK2), (SEQ ID NO: 568)
Proprotein Convertase Subtilisin/Kexin Type 3, (PCSK3), (SEQ ID NO: 569)
Proprotein Convertase Subtilisin/Kexin Type 3 Sol, (PCSK3_SOL), (SEQ ID NO: 570)
Proprotein Convertase Subtilisin/Kexin Type 4, (PCSK4), (SEQ ID NO: 571)
Proprotein Convertase Subtilisin/Kexin Type 5, (PCSK5), (SEQ ID NO: 572)
Proprotein Convertase Subtilisin/Kexin Type 6 (PCSK6), (SEQ ID NO: 573)
Proprotein Convertase Subtilisin/Kexin Type, (PCSK7), (SEQ ID NO: 574)
Proprotein Convertase Subtilisin/Kexin Type 8, (PCSK8), (SEQ ID NO: 575)
Proprotein Convertase Subtilisin/Kexin Type 9, (PCSK9), (SEQ ID NO: 576)
Membrane-Bound Transcription Factor Peptidase, Site 2, (MBTPS2), (SEQ ID NO: 577)
Carboxypeptidase E, (CPE), (SEQ ID NO: 578)

In various embodiments, the present methods and compositions find use in treating or preventing one or more of diseases or disorders in the table below. In various embodiments, the present methods and compositions find use in treating or preventing one or more of diseases or disorders in the table below for instance by modulating the genes associated with the diseases in the table below. In embodiments, the present methods and compositions find use in gene-editing the genes described in the below Table 2C using the present compositions.

TABLE 2C

| Category | Disease | Genes | Entrez ID |
|---|---|---|---|
| Disorders of carbohydrate metabolism | Galactosemia | GALT, GALK1, GALE | 2592, 2584, 2582 |
| | Essential fructosuria | KHK | 3795 |
| | Hereditary fructose intolerance | ALDOB | 229 |
| | Glycogen storage disease type I | G6PC, SLC37A4, SLC17A3 | 2538, 2542, 10786 |
| | Glycogen storage disease type II | GAA | 2548 |
| | Glycogen storage disease type III | AGL | 178 |
| | Glycogen storage disease type IV | GBE1 | 2632 |
| | Glycogen storage disease type V | PYGM | 5837 |
| | Glycogen storage disease type VI | PYGL | 5836 |
| | Glycogen storage disease type VII | PYGM | 5837 |
| | Glycogen storage disease type IX | PHKA1, PHKA2, PHKB, PHKG1, PHKG2 | 5255, 5256, 5257, 5260, 5261 |
| | Glycogen storage disease type XI | SLC2A2 | 6514 |
| | Glycogen storage disease type XII | ALDOA | 226 |
| | Glycogen storage disease type XIII | ENO1, ENO2, ENO3 | 2023, 2026, 2027 |
| | Glycogen storage disease type 0 | GYS1, GYS2 | 2997, 2998 |
| | Pyruvate carboxylase deficiency | PC | 5091 |
| | Pyruvate kinase deficiency | PKLR | 5313 |
| | Transaldolase deficiency | TALDO1 | 6888 |
| | Triosephosphate isomerase deficiency | TPI1 | 7167 |
| | Fructose bisphosphatase deficiency | FBP1 | 2203 |
| | Hyperoxaluria | AGXT, GRHPR | 189, 9380 |
| | Hexokinase deficiency | HK1 | 3098 |
| | Glucose-galactose malabsorption | SLC5A1 | 6523 |
| | Glucose-6-phosphate dehydrogenase deficiency | G6PD | 2539 |
| Disorders of amino acid metabolism | Alkaptonuria | HGD | 3081 |
| | Aspartylglucosaminuria | AGA | 175 |
| | Methylmalonic acidemia | MUT, MCEE, MMAA, MMAB, MMACHC, MMADHC, LMBRD1 | 4594, 84693, 166785, 326625, 25974, 27249, 55788 |
| | Maple syrup urine disease | BCKDHA, BCKDHB, DBT, DLD | 593, 594, 1629, 1738 |
| | Homocystinuria | CBS | 875 |
| | Tyrosinemia | FAH, TAT, HPD | 2184, 6898, 3242 |
| | Trimethylaminuria | FMO3 | 2328 |
| | Hartnup disease | SLC6A19 | 340024 |
| | Biotinidase deficiency | BTD | 686 |
| | Ornithine carbamoyltransferase deficiency | OTC | 5009 |
| | Carbamoyl-phosphate synthase I deficiency disease | CPS1 | 1373 |
| | Citrullinemia | ASS, SLC25A13 | 445, 10165 |
| | Hyperargininemia | ARG1 | 383 |
| | Hyperhomocysteinemia | MTHFR | 4524 |
| | Hypermethioninemia | MAT1A, GNMT, AHCY | 4143, 27232, 191 |
| | Hyperlysinemias | AASS | 10157 |
| | Nonketotic hyperglycinemia | GLDC, AMT, GCSH | 2731, 275, 2653 |
| | Propionic acidemia | PCCA, PCCB | 5095, 5096 |
| | Hyperprolinemia | ALDH4A1, PRODH | 8659, 5625 |
| | Cystinuria | SLC3A1, SLC7A9 | 6519, 11136 |
| | Dicarboxylic aminoaciduria | SLC1A1 | 6505 |
| | Glutaric acidemia type 2 | ETFB, ETFDH | 2108, 2109, 2110 |
| | Isovaleric acidemia | IVD | 3712 |
| | 2-Hydroxyglutaric aciduria | L2HGDH, D2HGDH | 79944, 728294 |
| Disorders of the urea cycle | N-Acetylglutamate synthase deficiency | NAGS | 162417 |
| | Argininosuccinic aciduria | ASL | 435 |
| | Argininemia | ARG1 | 383 |
| Disorders of fatty acid metabolism | Very long-chain acyl-coenzyme A dehydrogenase deficiency | ACADVL | 37 |
| | Long-chain 3-hydroxyacyl-coenzyme A dehydrogenase deficiency | HADHA | 3030 |
| | Medium-chain acyl-coenzyme A dehydrogenase deficiency | ACADM | 34 |
| | Short-chain acyl-coenzyme A dehydrogenase deficiency | ACADS | 35 |

TABLE 2C-continued

| Category | Disease | Genes | Entrez ID |
|---|---|---|---|
| | 3-hydroxyacyl-coenzyme A dehydrogenase deficiency | HADH | 3033 |
| | 2,4 Dienoyl-CoA reductase deficiency | NADK2 | 133686 |
| | 3-Hydroxy-3-methylglutaryl-CoA lyase deficiency | HMGCL | 3155 |
| | Malonyl-CoA decarboxylase deficiency | MLYCD | 23417 |
| | Systemic primary carnitine deficiency | SLC22A5 | 6584 |
| | Carnitine-acylcarnitine translocase deficiency | SLC25A20 | 788 |
| | Carnitine palmitoyltransferase I deficiency | CPT1A | 1374 |
| | Carnitine palmitoyltransferase II deficiency | CPT2 | 1376 |
| | Lysosomal acid lipase deficiency | LIPA | 3988 |
| | Gaucher's disease | GBA | 2629 |
| Disorders of porphyrin metabolism | Acute intermittent porphyria | HMBS | 3145 |
| | Gunther disease | UROS | 7390 |
| | Porphyria cutanea tarda | UROD | 7389 |
| | Hepatoerythropoietic porphyria | UROD | 7389 |
| | Hereditary coproporphyria | CPOX | 1371 |
| | Variegate porphyria | PPOX | 5498 |
| | Erythropoietic protoporphyria | FECH | 2235 |
| | Aminolevulinic acid dehydratase deficiency porphyria | ALAD | 210 |
| Lysosomal storage disorders | Farber disease | ASAH1 | 427 |
| | Krabbe disease | GALC | 2581 |
| | Galactosialidosis | CTSA | 5476 |
| | Fabry disease | GLA | 2717 |
| | Schindler disease | NAGA | 4668 |
| | GM1 gangliosidosis | GLB1 | 2720 |
| | Tay-Sachs disease | HEXA | 3073 |
| | Sandhoff disease | HEXB | 3074 |
| | GM2-gangliosidosis, AB variant | GM2A | 2760 |
| | Niemann-Pick disease | SMPD1, NPC1, NPC2 | 6609, 4864, 10577 |
| | Metachromatic leukodystrophy | ARSA, PSAP | 410, 5660 |
| | Multiple sulfatase deficiency | SUMF1 | 285362 |
| | Hurler syndrome | IDUA | 3425 |
| | Hunter syndrome | IDS | 3423 |
| | Sanfilippo syndrome | SGSH, NAGLU, HGSNAT, GNS | 6448, 4669, 138050, 2799 |
| | Morquio syndrome | GALNS, GLB1 | 2588, 2720 |
| | Maroteaux-Lamy syndrome | ARSB | 411 |
| | Sly syndrome | GUSB | 2990 |
| | Sialidosis | NEU1, NEU2, NEU3, NEU4 | 4758, 4759, 10825, 129807 |
| | I-cell disease | GNPTAB, GNPTG | 79158, 84572 |
| | Mucolipidosis type IV | MCOLN1 | 57192 |
| | Infantile neuronal ceroid lipofuscinosis | PPT1, PPT2 | 5538, 9374 |
| | Jansky-Bielschowsky disease | TPP1 | 1200 |
| | Batten disease | CLN1, CLN2, CLN3, CLN5, CLN6, MFSD8, CLN8, CTSD | 5538, 1200, 1201, 1203, 54982, 256471, 2055, 1509 |
| | Kufs disease, Type A | CLN6, PPT1 | 54982, 5538 |
| | Kufs disease, Type B | DNAJC5, CTSF | 80331, 8722 |
| | Alpha-mannosidosis | MAN2B1, MAN2B2, MAN2C1 | 4125, 23324, 4123 |
| | Beta-mannosidosis | MANBA | 4226 |
| | Fucosidosis | FUCA1 | 2517 |
| | Cystinosis | CTNS | 1497 |
| | Pycnodysostosis | CTSK | 1513 |
| | Salla disease | SLC17A5 | 26503 |
| | Infantile free sialic acid storage disease | SLC17A5 | 26503 |
| | Danon disease | LAMP2 | 3920 |
| Peroxisome biogenesis disorders | Zellweger syndrome | PEX1, PEX2, PEX3, PEX5, PEX6, PEX12 PEX14, PEX26 | 5189, 5828, 8504, 5830, 5190, 5193, 5195, 55670 |
| | Infantile Refsum disease | PEX1, PEX2, PEX26 | 5189, 5828, 55670 |
| | Neonatal adrenoleukodystrophy | PEX5, PEX1, PEX10, PEX13, PEX26 | 5830, 5189, 5192, 5194, 55670 |
| | RCDP Type 1 | PEX7 | 5191 |
| | Pipecolic acidemia | PAHX | 5264 |
| | Acatalasia | CAT | 847 |
| | Hyperoxaluria type 1 | AGXT | 189 |

TABLE 2C-continued

| Category | Disease | Genes | Entrez ID |
| --- | --- | --- | --- |
| | Acyl-CoA oxidase deficiency | ACOX1 | 51 |
| | D-bifunctional protein deficiency | HSD17B4 | 3295 |
| | Dihydroxyacetonephosphate acyltransferase deficiency | GNPAT | 8443 |
| | X-linked adrenoleukodystrophy | ABCD1 | 215 |
| | α-Methylacyl-CoA racemase deficiency | AMACR | 23600 |
| | RCDP Type 2 | DHAPAT | 8443 |
| | RCDP Type 3 | AGPS | 8540 |
| | Adult Refsum disease-1 | PHYH | 5264 |
| Mulibrey nanism | | TRIM37 | 4591 |
| Disorders of purine or pyrimidine metabolism | Lesch-Nyhan syndrome | HPRT | 3251 |
| | Adenine phosphoribosyltransferase deficiency | APRT | 353 |
| | Adenosine deaminase deficiency | ADA | 100 |
| | Adenosine monophosphate deaminase deficiency type 1 | AMPD1 | 270 |
| | Adenylosuccinate lyase deficiency | ADSL | 158 |
| | Dihydropyrimidine dehydrogenase deficiency | DPYD | 1806 |
| | Miller syndrome | DHODH | 1723 |
| | Orotic aciduria | UMPS | 7372 |
| | Purine nucleoside phosphorylase deficiency | PNP | 4860 |
| | Xanthinuria | XDH, MOCS1, MOCS2, GEPH | 7498, 4337, 4338, 10243 |

The Entrez entries listed in the table above are hereby incorporated by reference in their entireties.

Additional illustrative targets of the present invention include the cosmetic targets listed in Table 6 of International Patent Publication No. WO 2013/151671, the contents of which are hereby incorporated by reference in their entirety.

Further, in some embodiments, the present methods and compositions find use in targeting any of the proteins or in treatment of any of the diseases or disorders of Table 2A, Table 2B, and/or Table 2C. In various embodiments, the present invention contemplates the targeting of the full-length and/or truncated forms of any of the proteins disclosed in Table 2B. In various embodiments, the present invention contemplates the targeting of the precursor forms and/or mature forms and/or isoforms of any of the proteins disclosed in Table 2A, Table 2B, and/or Table 2C.

In various embodiments, the present invention contemplates the targeting of a protein having about 60% (e.g. about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, or about 99%) sequence identity with any of the protein sequences disclosed herein (e.g. in Table 2A, Table 2B, and/or Table 2C).

In various embodiments, the present invention contemplates the targeting of a protein comprising an amino acid sequence having one or more amino acid mutations relative to any of the protein sequences described herein (e.g. in Table 2A, Table 2B, and/or Table 2C). For example, the present invention contemplates the targeting of a protein comprising an amino acid sequence having 1, or 2, or 3, or 4, or 5, or 6, or 7, or 8, or 9, or 10, or 11, or 12 amino acid mutations relative to any of the protein sequences described herein (e.g. in Table 2A, Table 2B, and/or Table 2C). In embodiments, the one or more amino acid mutations may be independently selected from substitutions, insertions, deletions, and truncations.

In embodiments, the amino acid mutations are amino acid substitutions, and may include conservative and/or non-conservative substitutions.

"Conservative substitutions" may be made, for instance, on the basis of similarity in polarity, charge, size, solubility, hydrophobicity, hydrophilicity, and/or the amphipathic nature of the amino acid residues involved. The 20 naturally occurring amino acids can be grouped into the following six standard amino acid groups: (1) hydrophobic: Met, Ala, Val, Leu, Ile; (2) neutral hydrophilic: Cys, Ser, Thr; Asn, Gln; (3) acidic: Asp, Glu; (4) basic: His, Lys, Arg; (5) residues that influence chain orientation: Gly, Pro; and (6) aromatic: Trp, Tyr, Phe.

As used herein, "conservative substitutions" are defined as exchanges of an amino acid by another amino acid listed within the same group of the six standard amino acid groups shown above. For example, the exchange of Asp by Glu retains one negative charge in the so modified polypeptide. In addition, glycine and proline may be substituted for one another based on their ability to disrupt α-helices.

As used herein, "non-conservative substitutions" are defined as exchanges of an amino acid by another amino acid listed in a different group of the six standard amino acid groups (1) to (6) shown above.

In various embodiments, the substitutions may also include non-classical amino acids (e.g. selenocysteine, pyrrolysine, N-formylmethionine β-alanine, GABA and δ-Aminolevulinic acid, 4-aminobenzoic acid (PABA), D-isomers of the common amino acids, 2,4-diaminobutyric acid, α-amino isobutyric acid, 4-aminobutyric acid, Abu, 2-amino butyric acid, γ-Abu, ε-Ahx, 6-amino hexanoic acid, Aib, 2-amino isobutyric acid, 3-amino propionic acid, ornithine, norleucine, norvaline, hydroxyproline, sarcosme, citrulline, homocitrulline, cysteic acid, t-butylglycine, t-butylalanine, phenylglycine, cyclohexylalanine, β-alanine, fluoro-amino acids, designer amino acids such as β methyl amino acids, C α-methyl amino acids, N α-methyl amino acids, and amino acid analogs in general).

Methods of Manufacture

Chemical synthetic methods of the present compounds (e.g. of Formulae I-XVI) and/or pharmaceutical compositions and/or lipid aggregates and/or lipid carriers are described elsewhere herein.

The methods and compositions of the invention make use of certain cationic lipids, the synthesis, preparation and characterization of which is described elsewhere herein and in the accompanying Examples. In addition, the present invention provides methods of preparing lipid aggregates and/or lipid carriers, including those associated with a therapeutic agent, e.g., a nucleic acid.

In embodiments, the present lipid aggregates and/or lipid carriers, e.g. liposomes, are created using microfluidics. In embodiments, the present lipid aggregates and/or lipid carriers are manufactured using a Nanoassemblr instrument (Precision Nanosystems). In embodiments, syringe pumps are used to mix organic and aqueous solutions at a specified flowrate. Optionally, the ratio of the flowrate of the aqueous solution to that of the organic solution may be selected from about 1:1, about 2:1, about 3:1, about 4:1, about 5:1, about 6:1, about 8:1, or about 10:1. In embodiments, the organic solution comprises one or more of ethanol, acetone, acetonitrile, dimethyl sulfoxide, toluene, and chloroform, or a mixture thereof. In other embodiments, other solvents are used.

In embodiments, the present lipid aggregates and/or lipid carriers are manufactured by dropwise mixture of one solution into another. In embodiments, the present lipid aggregates and/or lipid carriers are manufactured with a spray mechanism, or by solvent evaporation, or by sonication, or by extrusion through one or more membranes, or through a process of self-assembly, or by a combination of methods.

In the methods described herein, a mixture of lipids is combined with a buffered aqueous solution of nucleic acid to produce an intermediate mixture containing nucleic acid encapsulated in lipid particles wherein the encapsulated nucleic acids are present in a nucleic acid/lipid ratio of about 3 wt % to about 25 wt %, e.g. 5 to 15 wt %. The intermediate mixture may optionally be sized to obtain lipid-encapsulated nucleic acid particles wherein the lipid portions are unilamellar vesicles, e.g. having a diameter of 30 to 150 nm, e.g. about 40 to 90 nm. The pH is then raised to neutralize at least a portion of the surface charges on the lipid-nucleic acid particles, thus providing an at least partially surface-neutralized lipid-encapsulated nucleic acid composition.

Several cationic lipids are amino lipids that are charged at a pH below the pKa of the amino group and substantially neutral at a pH above the pKa. These cationic lipids are termed titratable cationic lipids and can be used in the present compounds (e.g. of Formulae I-XVI) and/or pharmaceutical compositions and/or lipid aggregates and/or lipid carriers using a two-step process. First, lipid vesicles can be formed at the lower pH with titratable cationic lipids and other vesicle components in the presence of nucleic acids. In this manner, the vesicles will encapsulate and entrap the nucleic acids. Second, the surface charge of the newly formed vesicles can be neutralized by increasing the pH of the medium to a level above the pKa of the titratable cationic lipids present, i.e., to physiological pH or higher. Particularly advantageous aspects of this process include both the facile removal of any surface adsorbed nucleic acid and a resultant nucleic acid delivery vehicle which has a neutral surface. The present compounds (e.g. of Formulae I-XVI) and/or pharmaceutical compositions and/or lipid aggregates and/or lipid carriers and/or liposomes and/or lipid particles having a neutral surface are expected to avoid rapid clearance from circulation and to avoid certain toxicities which are associated with cationic liposome preparations. Additional details concerning these uses of such titratable cationic lipids in the formulation of nucleic acid-lipid particles are provided in U.S. Pat. Nos. 6,287,591 and 6,858,225, incorporated herein by reference.

Vesicles formed in this manner provide formulations of uniform vesicle size with high content of nucleic acids. Additionally, the vesicles have a size range of from about 30 to about 150 nm, e.g. about 30 to about 90 nm.

Without intending to be bound by any particular theory, it is believed that the very high efficiency of nucleic acid encapsulation is a result of electrostatic interaction at low pH. At acidic pH (e.g. pH 4.0) the vesicle surface is charged and binds a portion of the nucleic acids through electrostatic interactions. When the external acidic buffer is exchanged for a more neutral buffer (e.g., pH 7.5) the surface of the lipid particle or liposome is neutralized, allowing any external nucleic acid to be removed. More detailed information on the formulation process is provided in various publications (e.g., U.S. Pat. Nos. 6,287,591 and 6,858,225).

The present invention provides, in embodiments, methods of preparing lipid/nucleic acid formulations. In the methods described herein, a mixture of lipids is combined with a buffered aqueous solution of nucleic acid to produce an intermediate mixture containing nucleic acid encapsulated in lipid particles, e.g., wherein the encapsulated nucleic acids are present in a nucleic acid/lipid ratio of about 10 wt % to about 50 wt %. The intermediate mixture may optionally be sized to obtain lipid-encapsulated nucleic acid particles wherein the lipid portions are unilamellar vesicles, e.g. having a diameter of 30 to 150 nm, or about 40 to 90 nm. The pH is then raised to neutralize at least a portion of the surface charges on the lipid-nucleic acid particles, thus providing an at least partially surface-neutralized lipid-encapsulated nucleic acid composition.

In embodiments, the mixture of lipids includes at least two lipid components: a first lipid component of the present invention that is selected from among lipids which have a pKa such that the lipid is cationic at pH below the pKa and neutral at pH above the pKa, and a second lipid component that is selected from among lipids that prevent particle aggregation during lipid-nucleic acid particle formation. In embodiments, the amino lipid is a novel cationic lipid of the present invention.

In preparing the nucleic acid-lipid particles of the invention, the mixture of lipids is typically a solution of lipids in an organic solvent. This mixture of lipids can then be dried to form a thin film or lyophilized to form a powder before being hydrated with an aqueous buffer to form liposomes. Alternatively, in a method, the lipid mixture can be solubilized in a water miscible alcohol, such as ethanol, and this ethanolic solution added to an aqueous buffer resulting in spontaneous liposome formation. In embodiments, the alcohol is used in the form in which it is commercially available. For example, ethanol can be used as absolute ethanol (100%), or as 95% ethanol, the remainder being water. This method is described in more detail in U.S. Pat. No. 5,976,567, the entirety of which is incorporated herein by reference.

In embodiments, the mixture of lipids is a mixture of cationic lipids, neutral lipids (other than a cationic lipid), a sterol (e.g., cholesterol) and a PEG-modified lipid (e.g., a PEG-DMG or PEG-DMA) in an alcohol solvent. In embodiments, the lipid mixture consists essentially of a cationic lipid, a neutral lipid, cholesterol and a PEG-modified lipid in alcohol, e.g. ethanol. In embodiments, the first solution consists of the above lipid mixture in molar ratios of about 20-70% cationic lipid: 5-45% neutral lipid:20-55% cholesterol:0.5-15% PEG-modified lipid. In embodiments, the first solution consists essentially of a lipid chosen from Table 1, DSPC, Chol and PEG-DMG or PEG-DMA, e.g. in a molar ratio of about 20-60% cationic lipid:5-25% DSPC:25-55% Choi:0.5-15% PEG-DMG or PEG-DMA. In embodiments, the molar lipid ratio is approximately 40/10/40/10 (mol % cationic lipid/DSPC/Chol/PEG-DMG or PEG-DMA), 35/15/40/10 (mol % cationic lipid/DSPC/Chol/PEG-DMG or PEG-DMA) or 52/13/30/5 (mol % cationic lipid/DSPC/Chol/PEG-DMG or PEG-DMA). In embodiments, the neutral lipid in these compositions is replaced with POPC, DPPC, DOPE or SM.

In embodiments, the lipid mixture is combined with a buffered aqueous solution that may contain the nucleic acids. The buffered aqueous solution of is typically a solution in which the buffer has a pH of less than the pKa of the protonatable lipid in the lipid mixture. Examples of suitable buffers include citrate, phosphate, acetate, and MES. Buffers will be in the range of 1-1000 mM of the anion, depending on the chemistry of the nucleic acid being encapsulated, and optimization of buffer concentration may be significant to achieving high loading levels (see, e.g., U.S. Pat. Nos. 6,287,591 and 6,858,225). Alternatively, pure water acidified to pH 5-6 with chloride, sulfate or the like may be useful. In this case, it may be suitable to add 5% glucose, or another non-ionic solute which will balance the osmotic potential across the particle membrane when the particles are dialyzed to remove ethanol, increase the pH, or mixed with a pharmaceutically acceptable carrier such as normal saline. The amount of nucleic acid in buffer can vary, but will typically be from about 0.01 mg/mL to about 200 mg/mL, e.g. from about 0.5 mg/mL to about 50 mg/mL.

The mixture of lipids and the buffered aqueous solution of therapeutic nucleic acids is combined to provide an intermediate mixture. The intermediate mixture is typically a mixture of lipid particles having encapsulated nucleic acids. Additionally, the intermediate mixture may also contain some portion of nucleic acids which are attached to the surface of the lipid particles (liposomes or lipid vesicles) due to the ionic attraction of the negatively-charged nucleic acids and positively-charged lipids on the lipid particle surface (the amino lipids or other lipid making up the protonatable first lipid component are positively charged in a buffer having a pH of less than the pKa of the protonatable group on the lipid). In embodiments, the mixture of lipids is an alcohol solution of lipids and the volumes of each of the solutions is adjusted so that upon combination, the resulting alcohol content is from about 20% by volume to about 45% by volume. The method of combining the mixtures can include any of a variety of processes, often depending upon the scale of formulation produced. For example, when the total volume is about 10-20 mL or less, the solutions can be combined in a test tube and stirred together using a vortex mixer. Large-scale processes can be carried out in suitable production scale glassware.

Optionally, the lipid-encapsulated therapeutic agent (e.g., nucleic acid) complexes which are produced by combining the lipid mixture and the buffered aqueous solution of therapeutic agents (e.g. nucleic acids) can be sized to achieve a desired size range and relatively narrow distribution of lipid particle sizes. In embodiments, the compositions provided herein will be sized to a mean diameter of from about 70 to about 200 nm, e.g. about 90 to about 130 nm. Several techniques are available for sizing liposomes to a desired size. One sizing method is described in U.S. Pat. No. 4,737,323, the entirety of which is incorporated herein by reference. Sonicating a liposome suspension either by bath or probe sonication produces a progressive size reduction down to small unilamellar vesicles (SUVs) less than about 0.05 microns in size. Homogenization is another method which relies on shearing energy to fragment large liposomes into smaller ones. In a typical homogenization procedure, multilamellar vesicles are recirculated through a standard emulsion homogenizer until selected liposome sizes, typically between about 0.1 and 0.5 microns, are observed. In both methods, the particle size distribution can be monitored by conventional laser-beam particle size determination. For certain methods herein, extrusion is used to obtain a uniform vesicle size.

Extrusion of liposome compositions through a small-pore polycarbonate membrane or an asymmetric ceramic membrane results in a relatively well-defined size distribution. Typically, the suspension is cycled through the membrane one or more times until the desired liposome complex size distribution is achieved. The liposomes may be extruded through successively smaller-pore membranes, to achieve a gradual reduction in liposome size. In some instances, the lipid-nucleic acid compositions which are formed can be used without any sizing.

In embodiments, methods of the present invention further comprise a step of neutralizing at least some of the surface charges on the lipid portions of the lipid-nucleic acid compositions. By at least partially neutralizing the surface charges, unencapsulated nucleic acid is freed from the lipid particle surface and can be removed from the composition using conventional techniques. In embodiments, unencapsulated and surface adsorbed nucleic acids are removed from the resulting compositions through exchange of buffer solutions. For example, replacement of a citrate buffer (pH about 4.0, used for forming the compositions) with a HEPES-buffered saline (HBS pH about 7.5) solution, results in the neutralization of liposome surface and nucleic acid release from the surface. The released nucleic acid can then be removed via chromatography using standard methods, and then switched into a buffer with a pH above the pKa of the lipid used.

Optionally the lipid vesicles (i.e., lipid particles) can be formed by hydration in an aqueous buffer and sized using any of the methods described above prior to addition of the nucleic acid. As described above, the aqueous buffer should be of a pH below the pKa of the amino lipid. A solution of the nucleic acids can then be added to these sized, preformed vesicles. To allow encapsulation of nucleic acids into such pre-formed vesicles the mixture should contain an alcohol, such as ethanol. In the case of ethanol, it should be present at a concentration of about 20% (w/w) to about 45% (w/w).

In addition, it may be necessary to warm the mixture of pre-formed vesicles and nucleic acid in the aqueous buffer-ethanol mixture to a temperature of about 25° C. to about 50° C. depending on the composition of the lipid vesicles and the nature of the nucleic acid. It will be apparent to one of ordinary skill in the art that optimization of the encapsulation process to achieve a desired level of nucleic acid in the lipid vesicles will require manipulation of variable such as ethanol concentration and temperature. Once the nucleic acids are encapsulated within the performed vesicles, the external pH can be increased to at least partially neutralize the surface charge. Unencapsulated and surface adsorbed nucleic acids can then be removed.

Vaccines and Adjuvants

In some embodiments, the compounds and compositions of the present invention are associated with a protein or nucleic acid antigen composition. For instance, the present lipids (e.g. any one of Formulae I-XVI) may be associated with a protein or nucleic acid vaccine antigen (e.g. any of the proteins of interest described herein). For instance, the present invention may relate to a method of vaccinating against a disease, inclusive of any of the infectious disease described herein, by administering a present lipids (e.g. any one of Formulae I-XVI) in association with a protein or nucleic acid antigen composition (e.g. any of the proteins of interest described herein).

In embodiments, the protein or nucleic acid antigen is an betacoronavirus protein or an alphacoronavirus protein, or an antigenic fragment thereof, or a nucleic acid (e.g. RNA (e.g. mRNA) or DNA) encoding the same. In some embodiments, the betacoronavirus protein is selected from a SARS-CoV-2, SARS-CoV, MERS-CoV, HCoV-HKU1, and HCoV-0043 protein, or an antigenic fragment thereof, or a nucleic acid (e.g. RNA (e.g. mRNA) or DNA) encoding the same. In some embodiments, the alphacoronavirus protein is selected from a HCoV-NL63 and HCoV-229E protein, or an antigenic fragment thereof, or a nucleic acid (e.g. RNA (e.g. mRNA) or DNA) encoding the same.

In some embodiments, the protein or nucleic acid antigen is a coronavirus protein, or an antigenic fragment thereof, or a nucleic acid (e.g. RNA (e.g. mRNA) or DNA) encoding the same. In various embodiments, the coronavirus protein is a protein from SARS-CoV-2, such as, e.g., SARS-CoV-2 spike protein. In embodiments, the SARS-CoV-2 protein is selected from spike surface glycoprotein, membrane glycoprotein M, envelope protein E, and nucleocapsid phosphoprotein N, or an antigenic fragment thereof, or a nucleic acid (e.g. RNA (e.g. mRNA) or DNA) encoding the same. In embodiments, the SARS-CoV-2 protein selected from spike surface glycoprotein comprises S1, S2 and S2'.

In some embodiments, the coronavirus is a betacoronavirus or an alphacoronavirus. In some embodiments, the betacoronavirus is selected from a SARS-CoV-2, SARS-CoV, MERS-CoV, HCoV-HKU1, and HCoV-0043. In embodiments, the alphacoronavirus is selected from a HCoV-NL63 and HCoV-229E. In embodiments, the coronavirus is severe acute respiratory syndrome coronavirus 2 (SARS-CoV-2).

In embodiments, the protein or nucleic acid antigen is an influenza viral antigen, optionally selected from hemagglutinin (HA) protein, matrix 2 (M2) protein, and neuraminidase, or an antigenic fragment thereof, or a nucleic acid (e.g. RNA (e.g. mRNA) or DNA) encoding the same.

In embodiments, the disease or disorder for which vaccination is occurring is selected from diphtheria, tetanus, pertussis, influenza, pneumonia, hepatitis A, hepatitis B, polio, yellow fever, Human Papillomavirus (HPV) infection, anthrax, rabies, Japanese Encephalitis, meningitis, measles, mumps, rubella, gastroenteritis, smallpox, typhoid fever, varicella (chickenpox), rotavirus, and shingles. In some embodiments, the present invention relates to the treatment of hepatitis. Illustrative hepatitis that may be treated include, but is not limited to, hepatitis A, hepatitis B, hepatitis C, hepatitis D, hepatitis E, autoimmune hepatitis, alcoholic hepatitis, acute hepatitis, and chronic hepatitis.

In some embodiments, the compounds, compositions, or vaccines of the present invention further comprise an adjuvant, optionally selected from an aluminum gel or salt. In embodiments, the aluminum gel or salt is selected from aluminum hydroxide, aluminum phosphate, and aluminum sulfate. In some embodiments, the adjuvant is a nucleic acid encoding the chimeric protein or chimeric protein complex as described herein.

In some embodiments, the additional adjuvant is selected from oil-in-water emulsion formulations, saponin adjuvants, ovalbumin, Freunds Adjuvant, cytokines, and chitosans. Illustrative additional adjuvants include, but are not limited to: (1) ovalbumin (e.g. ENDOFIT), which is often used for biochemical studies; (2) oil-in-water emulsion formulations (with or without other specific immunostimulating agents such as muramyl peptides or bacterial cell wall components), such as for example (a) MF59 (PCT Publ. No. WO 90/14837), containing 5% Squalene, 0.5% Tween 80, and 0.5% Span 85 (optionally containing various amounts of MTP-PE) formulated into submicron particles using a microfluidizer such as, for example, Model HOy microfluidizer (Microfluidics, Newton, Mass.), (b) SAF, containing 10% Squalane, 0.4% Tween 80, 5% pluronic-blocked polymer L121, and thr-MDP either microfluidized into a submicron emulsion or vortexed to generate a larger particle size emulsion, (c) RIBI adjuvant system (RAS), (RIBI IMMUNOCHEM, Hamilton, MO.) containing 2% Squalene, 0.2% Tween 80, and, optionally, one or more bacterial cell wall components from the group of monophosphorylipid A (MPL), trehalose dimycolate (TDM), and cell wall skeleton (CWS), including MPL+CWS (DETOX™); and (d) ADD-AVAX (Invitrogen); (3) saponin adjuvants, such as STIMULON (Cambridge Bioscience, Worcester, Mass.) may be used or particles generated therefrom such as ISCOMs (immunostimulating complexes); (4) Complete Freunds Adjuvant (CFA) and Incomplete Freunds Adjuvant (IFA); (5) cytokines, such as interleukins (by way of non-limiting example, IL-1, IL-2, IL-4, IL-5, IL-6, IL-7, IL-12, etc.), interferons (e.g., gamma interferon), macrophage colony stimulating factor (M-CSF), tumor necrosis factor (TNF), etc; (6) chitosans and other derivatives of chitin or poly-N-acetyl-D-glucosamine in which the greater proportion of the N-acetyl groups have been removed through hydrolysis (see, e.g., European Patent Application EP0460020, which is hereby incorporated by reference in its entirety, disclosing pharmaceutical formulations including chitosans as mucosal absorption enhancers); and (7) other substances that act as immunostimulating agents to enhance the effectiveness of the composition, e.g., monophosphoryl lipid A. In other embodiments, the additional adjuvant is one or more of an aluminum salt or gel, a pattern recognition receptors (PRR) agonist, CpG ODNs and imidazoquinolines. In some embodiments, the additional adjuvant is one or more of cyclic [G(3',5')pA(3',5')p] (e.g. 3'3'-cGAMP VACCIGRADE); cyclic [G(2',5')pA(3',5')p]2'3' (e.g. 2'3' cGAMP VACCIGRADE); cyclic [G(2',5')pA(2',5')p] (e.g. 2'2'-cGAMP VACCIGRADE), cyclic diadenylate monophosphate (e.g. c-di-AMP VACCIGRADE); cyclic diguanylate monophosphate (e.g. c-di-GMP VACCIGRADE); TLR7 agonist-imidazoquinolines compound (e.g. TLR7 agonists, such as, for example, Gardiquimod VACCIGRADE, Imiquimod VACCIGRADE, R848 VACCIGRADE); lipopolysaccharides (e.g. TLR4 agonists), such as that from E. coli 0111:B4 strain (e.g. LPS-EB VACCIGRADE); monophosphoryl lipid A (e.g. MPLA-SM VACCIGRADE and MPLA Synthetic VACCIGRADE); N-glycolylated muramyldipeptide (e.g. N-Glycolyl-MDP VACCIGRADE); CpG ODN, class A and/oror CpG ODN, class B and/or CpG ODN, class C (e.g. ODN 1585 VACCIGRADE, ODN 1826 VACCIGRADE, ODN 2006 VACCIGRADE, ODN 2395 VACCIGRADE), a triacylated lipoprotein (e.g. Pam3CSK4 VACCIGRADE); Polyinosine-polycytidylic acid (e.g. Poly(I:C)

(HMW) VACCIGRADE); and cord factor (i.e. mycobacterial cell wall component trehalose 6,6' dimycolate (TDM)) or an analog thereof (e.g. TDB VACCIGRADE, TDB-HS15 VACCIGRADE). In some embodiments, the additional adjuvant is a TLR agonist (e.g. TLR1, and/or TLR2, and/or TLR3, and/or TLR4, and/or TLR5, and/or TLR6, and/or TLR7, and/or TLR8, and/or TLR9, and/or TLR10, and/or TLR11, and/or TLR12, and/or TLR13), a nucleotide-binding oligomerization domain (NOD) agonist, a stimulator of interferon genes (STING) ligand, or related agent.

In some embodiments, the additional adjuvant is one or more of a mineral adjuvant, gel-based adjuvant, tensoactive agent, bacterial product, oil emulsion, particulated adjuvant, fusion protein, and lipopeptide. Other mineral salt adjuvants, besides the aluminum adjuvants described elsewhere, include salts of calcium (e.g. calcium phosphate), iron and zirconium. Other gel-based adjuvants, besides the aluminum gel-based adjuvants described elsewhere, include Acemannan. Tensoactive agents include Quil A, saponin derived from an aqueous extract from the bark of *Quillaja saponaria*; saponins, tensoactive glycosides containing a hydrophobic nucleus of triterpenoid structure with carbohydrate chains linked to the nucleus, and QS-21. Bacterial products include cell wall peptidoglycan or lipopolysaccharide of Gram-negative bacteria (e.g. from *Mycobacterium* spp., *Corynebacterium parvum, C. granulosum, Bordetella pertussis* and *Neisseria meningitidis*), N-acetyl muramyl-L-alanyl-D-isoglutamine (MDP), different compounds derived from MDP (e.g. threonyl-MDP), lipopolysaccharides (LPS) (e.g. from the cell wall of Gram-negative bacteria), trehalose dimycolate (TDM), and DNA containing CpG motifs. Oil emulsions include FIA, Montanide, Adjuvant 65, Lipovant, the montanide family of oil-based adjuvants, and various liposomes. Among particulated and polymeric systems, poly (DL-lactide-coglycolide) microspheres have been extensively studied and find use herein.

In some embodiments, the additional adjuvants are described in Jennings et al. Adjuvants and Delivery Systems for Viral Vaccines-Mechanisms and Potential. In: Brown F, Haaheim L R, (eds). Modulation of the Immune Response to Vaccine Antigens. Dev. Biol. Stand, Vol. 92. Basel: Karger 1998; 19-28 and/or Sayers et al. J Biomed Biotechnol. 2012; 2012: 831486, and/or Petrovsky and Aguilar, Immunology and Cell Biology (2004) 82, 488-496 the contents of which are hereby incorporated by reference in their entireties.

Administration/Dosage/Excipients

Administration of these compositions according to the present invention may be via any common route so long as the target tissue is available via that route. This includes oral, nasal, or buccal. Alternatively, administration may be by intradermal, subcutaneous, intramuscular, intraperitoneal, intraportal or intravenous injection, or by direct injection into diseased, e.g. cancer, tissue. The agents disclosed herein may also be administered by catheter systems. Such compositions would normally be administered as pharmaceutically acceptable compositions as described herein.

In embodiments, the present compositions are administered parenterally, e.g., intraarticularly, intravenously, intraperitoneally, subcutaneously, or intramuscularly. In embodiments, the pharmaceutical compositions are administered intravenously or intraperitoneally by a bolus injection.

In some embodiments, lipid-nucleic acid compositions can be administered in an aerosol inhaled into the lungs (see, Brigham, et al., *Am. J. Sci.* 298(4):278-281 (1989)), optionally by the use of a vibrating-mesh nebulizer (e.g., without limitation, AEROGEN SOLO (Galway, Ireland)). In some embodiments, the lipid-nucleic acid compositions can be administered by direct injection at the site of disease (Culver, Human Gene Therapy, MaryAnn Liebert, Inc., Publishers, New York. pp. 70-71 (1994)).

Administration of the compositions described herein may be, for example, by injection, topical administration, ophthalmic administration, and intranasal administration. The injection, in some embodiments, may be linked to an electrical force (e.g. electroporation, including with devices that find use in electrochemotherapy (e.g. CLINIPORATOR, IGEA Srl, Carpi [MO], Italy)). The topical administration may be, but is not limited to, a cream, lotion, ointment, gel, spray, solution and the like. The topical administration may further include a penetration enhancer such as, but not limited to, surfactants, fatty acids, bile salts, chelating agents, non-chelating non-surfactants, polyoxyethylene-9-lauryl ether, polyoxyethylene-20-cetyl ether, fatty acids and/or salts in combination with bile acids and/or salts, sodium salt in combination with lauric acid, capric acid and UDCA, and the like. The topical administration may also include a fragrance, a colorant, a sunscreen, an antibacterial, and/or a moisturizer. The compositions described herein may be administered to at least one site such as, but not limited to, forehead, scalp, hair follicles, hair, upper eyelids, lower eyelids, eyebrows, eyelashes, infraorbital area, periorbital areas, temple, nose, nose bridge, cheeks, tongue, nasolabial folds, lips, periobicular areas, jaw line, ears, neck, breast, forearm, upper arm, palm, hand, finger, nails, back, abdomen, sides, buttocks, thigh, calf, feet, toes and the like.

Routes of administration include, for example: intradermal, intramuscular, intraperitoneal, intravenous, subcutaneous, intranasal, epidural, oral, sublingual, intracerebral, intravaginal, transdermal, intraportal, rectally, by inhalation, or topically, particularly to the ears, nose, eyes, or skin. In embodiments, the administering is effected orally or by parenteral injection.

Upon formulation, solutions may be administered in a manner compatible with the dosage formulation and in such amount as is therapeutically effective, as described herein. The formulations may easily be administered in a variety of dosage forms such as injectable solutions, drug release capsules and the like. For parenteral administration in an aqueous solution, for example, the solution generally is suitably buffered and the liquid diluent first rendered isotonic with, for example, sufficient saline or glucose. Such aqueous solutions may be used, for example, for intravenous, intramuscular, subcutaneous, and intraperitoneal administration. Preferably, sterile aqueous media are employed as is known to those of skill in the art, particularly in light of the present disclosure.

In embodiments, the nucleic acid and present lipids is administered locally, optionally by one or more of subcutaneous injection, intradermal injection, subdermal injection and intramuscular injection, and the effective dose is administered to a surface area of about 4 mm$^2$ to about 150 mm$^2$ (e.g. about, or no more than about, 4 mm$^2$, or about 5 mm$^2$, or about 6 mm$^2$, or about 7 mm$^2$, or about 8 mm$^2$, or about 10 mm$^2$, or about 20 mm$^2$, or about 50 mm$^2$, or about 100 mm$^2$, or about 150 mm$^2$). In various embodiments, the nucleic acid and present lipids is administered locally, optionally by one or more of subcutaneous injection, intradermal injection, subdermal injection and intramuscular injection, and the effective dose administered to a surface area of no more than about 4 mm$^2$, or about 5 mm$^2$, or about 6 mm$^2$, or about 7 mm$^2$, or about 8 mm$^2$, or about 10 mm$^2$, or about 20 mm$^2$, or about 50 mm$^2$, or about 100 mm$^2$, or about 150 mm$^2$.

In various embodiments, the nucleic acid and present lipids is administered locally, optionally by one or more of subcutaneous injection, intradermal injection, subdermal injection and intramuscular injection, and the effective dose administered to a surface area of about 4 mm$^2$, or about 5 mm$^2$, or about 6 mm$^2$, or about 7 mm$^2$, or about 8 mm$^2$, or about 10 mm$^2$, or about 20 mm$^2$, or about 50 mm$^2$, or about 100 mm$^2$, or about 150 mm$^2$.

In various embodiments, the nucleic acid and present lipids is administered locally, optionally by one or more of subcutaneous injection, intradermal injection, subdermal injection and intramuscular injection, and the effective dose (weight RNA/surface area of injection) is about 35 ng/cm$^2$ to about 7000 ng/cm$^2$. In various embodiments, the nucleic acid and present lipids is administered locally, optionally by one or more of subcutaneous injection, intradermal injection, subdermal injection and intramuscular injection, and the effective dose (weight RNA/surface area of injection) is no more than about 35 ng/cm$^2$, or about 50 ng/cm$^2$, or about 75 ng/cm$^2$, or about 100 ng/cm$^2$, or about 125 ng/cm$^2$, or about 150 ng/cm$^2$, or about 175 ng/cm$^2$, or about 200 ng/cm$^2$, or about 225 ng/cm$^2$, or about 250 ng/cm$^2$, or about 500 ng/cm$^2$, or about 1000 ng/cm$^2$, or about 2000 ng/cm$^2$, or about 5000 ng/cm$^2$, or about 7000 ng/cm$^2$. In various embodiments, nucleic acid and present lipids is administered locally, optionally by one or more of subcutaneous injection, intradermal injection, subdermal injection and intramuscular injection, and the effective dose (weight RNA/surface area of injection) is about 35 ng/cm$^2$, or about 50 ng/cm$^2$, or about 75 ng/cm$^2$, or about 100 ng/cm$^2$, or about 125 ng/cm$^2$, or about 150 ng/cm$^2$, or about 175 ng/cm$^2$, or about 200 ng/cm$^2$, or about 225 ng/cm$^2$, or about 250 ng/cm$^2$, or about 500 ng/cm$^2$, or about 1000 ng/cm$^2$, or about 2000 ng/cm$^2$, or about 5000 ng/cm$^2$, or about 7000 ng/cm$^2$.

In some embodiments, the effective dose is about 100 ng to about 5000 ng (e.g., about, or no more than about, 100 ng, or 200 ng, or 300 ng, or 400 ng, or 500 ng, or 600 ng, or 700 ng, or 800 ng, or 900 ng, or 1000 ng, or 1100 ng, or 1200 ng, or 1300 ng, or 1400 ng, or 1500 ng, or 1600 ng, or 1700 ng, or 1800 ng, or 1900 ng, or 2000 ng, or 3000 ng, or 4000 ng, or 5000 ng). In other embodiments, the effective dose is less than about 100 ng. In certain embodiments, the effective dose is about 10 ng to about 100 ng (e.g., about, or no more than about, 10 ng, or 20 ng, or 30 ng, or 40 ng, or 50 ng, or 60 ng, or 70 ng, or 80 ng, or 90 ng, or 100 ng).

In some embodiments, the effective dose is about 1.4 ng/kg to about 30 ng/kg (e.g., about, or no more than about, 1.4 ng/kg, or 2.5 ng/kg, or 5 ng/kg, or 10 ng/kg, or 15 ng/kg, or 20 ng/kg, or 25 ng/kg, or 30 ng/kg). In other embodiments, the effective dose is less than about 1.5 ng/kg. In certain embodiments, the effective dose is about 0.14 ng/kg to about 1.4 ng/kg (e.g., about, or no more than about, 0.14 ng/kg, or 0.25 ng/kg, or 0.5 ng/kg, or 0.75 ng/kg, or 1 ng/kg, or 1.25 ng/kg, or 1.4 ng/kg).

In some embodiments, the effective dose is about 350 ng/cm$^2$ to about 7000 ng/cm$^2$ (e.g., about, or no more than about, 350 ng/cm$^2$, or 500 ng/cm$^2$, or 750 ng/cm$^2$, or 1000 ng/cm$^2$, or 2000 ng/cm$^2$, or 3000 ng/cm$^2$, or 4000 ng/cm$^2$, or 5000 ng/cm$^2$, or 6000 ng/cm$^2$, or 7000 ng/cm$^2$). In other embodiments, the effective dose is less than about 350 ng/cm$^2$.

In certain embodiments, the effective dose is about 35 ng/cm$^2$ to about 350 ng/cm$^2$ (e.g., about, or no more than about, 35 ng/cm$^2$, or 50 ng/cm$^2$, or 75 ng/cm$^2$, or 100 ng/cm$^2$, or 150 ng/cm$^2$, or 200 ng/cm$^2$, or 250 ng/cm$^2$, or 300 ng/cm$^2$, or 350 ng/cm$^2$.

In some embodiments, the effective dose of the nucleic acid drug, including synthetic RNA, is about 1 ng to about 2000 ng, or about 10 ng to about 2000 ng, or about 100 ng to about 2000 ng, or about 200 ng to about 1900 ng, or about 300 ng to about 1800 ng, or about 400 ng to about 1700 ng, or about 500 ng to about 1600 ng, or about 600 ng to about 1500 ng, or about 700 ng to about 1400 ng, or about 800 ng to about 1300 ng, or about 900 ng to about 1200 ng, or about 1000 ng to about 1100 ng, or about 500 ng to about 2000 ng, or about 500 ng to about 1500 ng, or about 500 ng to about 1000 ng, or about 1000 ng to about 1500 ng, or about 1000 ng to about 2000 ng, or about 1500 ng to about 2000 ng, or about 100 ng to about 500 ng, or about 200 ng to about 400 ng, or about 10 ng to about 100 ng, or about 20 ng to about 90 ng, or about 30 ng to about 80 ng, or about 40 ng to about 70 ng, or about 50 ng to about 60 ng.

In some embodiments, the effective dose of the nucleic acid drug, including synthetic RNA, is no more than about 1 ng, no more than about 10 ng, no more than about 30 ng, no more than about 50 ng, or about 100 ng, or about 200 ng, or about 300 ng, or about 400 ng, or about 500 ng, or about 600 ng, or about 700 ng, or about 800 ng, or about 900 ng, or about 1000 ng, or about 1100 ng, or about 1200 ng, or about 1300 ng, or about 1400 ng, or about 1500 ng, or about 1600 ng, or about 1700 ng, or about 1800 ng, or about 1900 ng, or about 2000 ng, or about 3000 ng, or about 4000 ng, or about 5000 ng.

In some embodiments, the effective dose of the nucleic acid drug, including synthetic RNA, is about 1 ng, or about 10 ng, or about 30 ng, or about 50 ng, or about 100 ng, or about 200 ng, or about 300 ng, or about 400 ng, or about 500 ng, or about 600 ng, or about 700 ng, or about 800 ng, or about 900 ng, or about 1000 ng, or about 1100 ng, or about 1200 ng, or about 1300 ng, or about 1400 ng, or about 1500 ng, or about 1600 ng, or about 1700 ng, or about 1800 ng, or about 1900 ng, or about 2000 ng, or about 3000 ng, or about 4000 ng, or about 5000 ng.

In some embodiments, the effective dose of the nucleic acid drug, including synthetic RNA, is about 0.028 pmol, or about 0.05 pmol, or about 0.1 pmol, or about 0.2 pmol, or about 0.3 pmol, or about 0.4 pmol, or about 0.5 pmol, or about 0.6 pmol, or about 0.7 pmol, or about 0.8 pmol, or about 0.9 pmol, or about 1.0 pmol, or about 1.2 pmol, or about 1.4 pmol, or about 1.6 pmol, or about 1.8 pmol, or about 2.0 pmol, or about 2.2 pmol, or about 2.4 pmol, or about 2.6 pmol, or about 2.8 pmol, or about 3.0 pmol, or about 3.2 pmol, or about 3.4 pmol, or about 3.6 pmol, or about 3.8 pmol, or about 4.0 pmol, or about 4.2 pmol, or about 4.4 pmol, or about 4.6 pmol, or about 4.8 pmol, or about 5.0 pmol, or about 5.5 pmol, or about 5.7 pmol.

In some embodiments, the nucleic acid drug, including synthetic RNA, is administered at a concentration of about 0.1 nM, or about 0.25 nM, or about 0.5 nM, or about 0.75 nM, or about 1 nM, or about 2.5 nM, or about 5 nM, or about 7.5 nM, or about 10 nM, or about 20 nM, or about 30 nM, or about 40 nM, or about 50 nM, or about 60 nM, or about 70 nM, or about 80 nM, or about 90 nM, or about 100 nM, or about 110 nM, or about 120 nM, or about 150 nM, or about 175 nM, or about 200 nM.

In some embodiments, the effective dose of the nucleic acid drug is about 350 ng/cm$^2$, or about 500 ng/cm$^2$, or about 750 ng/cm$^2$, or about 1000 ng/cm$^2$, or about 2000 ng/cm$^2$, or about 3000 ng/cm$^2$, or about 4000 ng/cm$^2$, or about 5000 ng/cm$^2$, or about 6000 ng/cm$^2$, or about 7000 ng/cm$^2$. In other embodiments, the effective dose is less than about 350 ng/cm$^2$. In certain embodiments, the effective dose is about 35 ng/cm$^2$, or about 50 ng/cm$^2$, or about 75 ng/cm$^2$, or about 100 ng/cm$^2$, or about 150 ng/cm$^2$, or about 200 ng/cm$^2$, or about 250 ng/cm$^2$, or about 300 ng/cm$^2$, or about 350 ng/cm$^2$.

In some embodiments, the effective dose of the nucleic acid drug is about 35 ng/cm$^2$ to about 7000 ng/cm$^2$, or about 50 ng/cm$^2$ to about 5000 ng/cm$^2$, or about 100 ng/cm$^2$ to about 3000 ng/cm$^2$, or about 500 ng/cm$^2$ to about 2000 ng/cm$^2$, or about 750 ng/cm$^2$ to about 1500 ng/cm$^2$, or about 800 ng/cm$^2$ to about 1200 ng/cm$^2$, or about 900 ng/cm$^2$ to about 1100 ng/cm$^2$.

In some embodiments, the effective dose of the nucleic acid drug is about 1 picomole/cm$^2$, or about 2 picomoles/cm$^2$, or about 3 picomoles/cm$^2$, or about 4 picomoles/cm$^2$, or about 5 picomoles/cm$^2$, or about 6 picomoles/cm$^2$, or about 7 picomoles/cm$^2$, or about 8 picomoles/cm$^2$, or about 9 picomoles/cm$^2$, or about 10 picomoles/cm$^2$, or about 12 picomoles/cm$^2$, or about 14 picomoles/cm$^2$, or about 16 picomoles/cm$^2$, or about 18 picomoles/cm$^2$, or about 20 picomoles/cm$^2$. In other embodiments, the effective dose is less than about 1 picomole/cm$^2$. In certain embodiments, the effective dose is about 0.1 picomoles/cm$^2$, or about 0.2 picomoles/cm$^2$, or about 0.3 picomoles/cm$^2$, or about 0.4 picomoles/cm$^2$, or about 0.5 picomoles/cm$^2$, or about 0.6 picomoles/cm$^2$, or about 0.7 picomoles/cm$^2$, or about 0.8 picomoles/cm$^2$, or about 0.9 picomoles/cm$^2$, or about 1 picomole/cm$^2$.

In some embodiments, the effective dose of the nucleic acid drug is about 0.1 picomoles/cm$^2$ to about 20 picomoles/cm$^2$, or about 0.2 picomoles/cm$^2$ to about 15 picomoles/cm$^2$, or about 0.5 picomoles/cm$^2$ to about 10 picomoles/cm$^2$, or about 0.8 picomoles/cm$^2$ to about 8 picomoles/cm$^2$, or about 1 picomole/cm$^2$ to about 5 picomoles/cm$^2$, or about 2 picomoles/cm$^2$ to about 4 picomoles/cm$^2$.

For example, the present compositions can be in the form of pharmaceutically acceptable salts. Such salts include those listed in, for example, *J. Pharma. Sci.* 66, 2-19 (1977) and *The Handbook of Pharmaceutical Salts; Properties, Selection, and Use*. P. H. Stahl and C. G. Wermuth (eds.), Verlag, Zurich (Switzerland) 2002, which are hereby incorporated by reference in their entirety. Non-limiting examples of pharmaceutically acceptable salts include: sulfate, citrate, acetate, oxalate, chloride, bromide, iodide, nitrate, bisulfate, phosphate, acid phosphate, isonicotinate, lactate, salicylate, acid citrate, tartrate, oleate, tannate, pantothenate, bitartrate, ascorbate, succinate, maleate, gentisinate, fumarate, gluconate, glucaronate, saccharate, formate, benzoate, glutamate, methanesulfonate, ethanesulfonate, benzenesulfonate, p-toluenesulfonate, camphorsulfonate, pamoate, phenylacetate, trifluoroacetate, acrylate, chlorobenzoate, dinitrobenzoate, hydroxybenzoate, methoxybenzoate, methylbenzoate, o-acetoxybenzoate, naphthalene-2-benzoate, isobutyrate, phenylbutyrate, α-hydroxybutyrate, butyne-1,4-dicarboxylate, hexyne-1,4-dicarboxylate, caprate, caprylate, cinnamate, glycollate, heptanoate, hippurate, malate, hydroxymaleate, malonate, mandelate, mesylate, nicotinate, phthalate, teraphthalate, propiolate, propionate, phenylpropionate, sebacate, suberate, p-bromobenzenesulfonate, chlorobenzenesulfonate, ethylsulfonate, 2-hydroxyethylsulfonate, methylsulfonate, naphthalene-1-sulfonate, naphthalene-2-sulfonate, naphthalene-1,5-sulfonate, xylenesulfonate, tartarate salts, hydroxides of alkali metals such as sodium, potassium, and lithium; hydroxides of alkaline earth metal such as calcium and magnesium; hydroxides of other metals, such as aluminum and zinc; ammonia, and organic amines, such as unsubstituted or hydroxy-substituted mono-, di-, or tri-alkylamines, dicyclohexylamine; tributyl amine; pyridine; N-methyl, N-ethylamine; diethylamine; triethylamine; mono-, bis-, or tris-(2-0H-lower alkylamines), such as mono-; bis-, or tris-(2-hydroxyethyl)amine, 2-hydroxy-tert-butylamine, or tris-(hydroxymethyl)methylamine, N,N-di-lower alkyl-N-(hydroxyl-lower alkyl)-amines, such as N,N-dimethyl-N-(2-hydroxyethyl)amine or tri-(2-hydroxyethyl)amine; N-methyl-D-glucamine; and amino acids such as arginine, lysine, and the like.

The present pharmaceutical compositions can comprise excipients, including liquids such as water and oils, including those of petroleum, animal, vegetable, or synthetic origin, such as peanut oil, soybean oil, mineral oil, sesame oil and the like. The pharmaceutical excipients can be, for example, saline, gum acacia, gelatin, starch paste, talc, keratin, colloidal silica, urea, and the like. In addition, auxiliary, stabilizing, thickening, lubricating, and coloring agents can be used. In one embodiment, the pharmaceutically acceptable excipients are sterile when administered to a subject.

Suitable pharmaceutical excipients also include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol, and the like. Any agent described herein, if desired, can also comprise minor amounts of wetting or emulsifying agents, or pH buffering agents.

Subjects/Patients/Hosts

Illustrative subjects or patients or hosts refers to any vertebrate including, without limitation, humans and other primates (e.g., chimpanzees and other apes and monkey species), farm animals (e.g., cattle, sheep, pigs, goats, and horses), domestic mammals (e.g., dogs and cats), laboratory animals (e.g., rodents such as mice, rats, and guinea pigs), and birds (e.g., domestic, wild and game birds such as chickens, turkeys and other gallinaceous birds, ducks, geese, and the like). In embodiments, the subject is a mammal. In embodiments, the subject is a human. In certain embodiments, the subject is an invertebrate. In other embodiments, the subject is a plant.

Kits

The invention also provides kits that can simplify the transfection of the nucleic acids described herein. An illustrative kit of the invention comprises one or more of the present compounds (e.g. of Formulae I-XVI) and/or pharmaceutical compositions and/or lipid aggregates and/or lipid carriers. The kit may also include transfection media, transfection reagents, and/or various vessels for culturing of cells.

Definitions

The terms "a", "an", and "the" as used herein, generally is construed to cover both the singular and the plural forms.

The term "H" denotes a single hydrogen atom. This radical may be attached, for example, to an oxygen atom to form a hydroxyl radical.

Where the term "alkyl" is used, either alone or within other terms such as "haloalkyl" or "alkylamino", it embraces linear or branched radicals having one to about twenty carbon atoms, denoted as $C_1$-$C_{20}$ alkyl. Examples of such radicals include methyl, ethyl, n-propyl, isopropyl, n-butyl, isobutyl, sec-butyl, tert-butyl, pentyl, isoamyl, hexyl and the like. The term "alkylenyl," "alkylene," or "alkanediyl," embraces bridging divalent alkyl radicals such as methylenyl or ethylenyl.

The term "alkenyl" embraces linear or branched radicals of two to about sixty carbon atoms having at least one carbon-carbon double bond. In some instances, the "alkenyl" radical has two carbon-carbon double bonds that may or may not be conjugated. In some instances, the "alkenyl" radical has more than two carbon-carbon double bonds that independently may or may not be conjugated. In some instances, the "alkenyl" radical has at least one carbon-carbon double bond and at least one carbon-carbon triple bond that may or may not be conjugated. Examples of alkenyl radicals include ethenyl, propenyl, allyl, propenyl, butenyl and 4-methylbutenyl. The terms "alkenyl" embraces radicals having "cis" and "trans" orientations, or alternatively, "E" and "Z" orientations.

The term "alkynyl" denotes linear or branched radicals having at least one carbon-carbon triple bond and having two to about sixty carbon atoms. Examples of such radicals include propargyl, and butynyl, and the like.

Alkyl, alkylenyl, alkenyl, and alkynyl radicals may be optionally substituted with one or more functional groups such as halo, hydroxy, nitro, amino, cyano, haloalkyl, aryl, heteroaryl, and heterocyclo and the like.

The term "halo" means halogens such as fluorine, chlorine, bromine or iodine atoms.

The term "haloalkyl" embraces radicals wherein any one or more of the alkyl carbon atoms is substituted with halo as defined above. Specifically embraced are monohaloalkyl, dihaloalkyl and polyhaloalkyl radicals including perhaloalkyl. A monohaloalkyl radical, for example, may have either an iodo, bromo, chloro or fluoro atom within the radical. Dihalo and polyhaloalkyl radicals may have two or more of the same halo atoms or a combination of different halo radicals. Even more preferred are lower haloalkyl radicals having one to three carbon atoms. Examples of haloalkyl radicals include fluoromethyl, difluoromethyl, trifluoromethyl, chloromethyl, dichloromethyl, trichloromethyl, pentafluoroethyl, heptafluoropropyl, difluorochloromethyl, dichlorofluoromethyl, difluoroethyl, difluoropropyl, dichloroethyl and dichloropropyl.

The term "hydroxyalkyl" embraces linear or branched alkyl radicals having one to about ten carbon atoms any one of which may be substituted with one or more hydroxyl radicals. Examples of such radicals include hydroxymethyl, hydroxyethyl, hydroxypropyl, hydroxybutyl and hydroxyhexyl.

The term "alkoxy" embraces linear or branched oxy-containing radicals each having alkyl portions of one to about twenty carbon atoms. Examples of such radicals include methoxy, ethoxy, propoxy, butoxy and tert-butoxy. Even more preferred are lower alkoxy radicals having one to twelve carbon atoms. Alkoxy radicals may be further substituted with one or more halo atoms, such as fluoro, chloro or bromo, to provide "haloalkoxy" radicals. Examples of such radicals include fluoromethoxy, chloromethoxy, trifluoromethoxy, trifluoroethoxy, fluoroethoxy and fluoropropoxy.

The term "aryl", alone or in combination, means a carbocyclic aromatic system containing one or two rings, wherein such rings may be attached together in a fused manner. The term "aryl" embraces aromatic radicals such as phenyl, naphthyl, indenyl, tetrahydronaphthyl, and indanyl. More preferred aryl is phenyl. An "aryl" group may have 1 or more substituents such as alkyl, hydroxyl, halo, haloalkyl, nitro, cyano, alkoxy, and alkylamino, and the like. The term "arylene" embraces bridging divalent aryl radicals, such as benzylene, phenylene, and the like.

The term "heterocyclyl" (or "heterocyclo") embraces saturated, partially saturated and unsaturated heteroatom-containing ring radicals, where the heteroatoms may be selected from nitrogen, sulfur and oxygen. The "heterocyclyl" group may have 1 to 4 substituents such as hydroxyl, Boc, halo, haloalkyl, cyano, lower alkyl, lower aralkyl, oxo, lower alkoxy, amino and lower alkylamino.

Examples of saturated heterocyclic radicals include saturated 3 to 6-membered heteromonocyclic groups containing 1 to 4 nitrogen atoms [e.g., pyrrolidinyl, imidazolidinyl, piperidinyl, pyrrolinyl, piperazinyl]; saturated 3 to 6-membered heteromonocyclic group containing 1 to 2 oxygen atoms and 1 to 3 nitrogen atoms [e.g., morpholinyl]; saturated 3 to 6-membered heteromonocyclic group containing 1 to 2 sulfur atoms and 1 to 3 nitrogen atoms [e.g., thiazolidinyl]. Examples of partially saturated heterocyclyl radicals include dihydrothienyl, dihydropyranyl, dihydrofuryl and dihydrothiazolyl.

Examples of unsaturated heterocyclic radicals, also termed "heteroaryl" radicals, include unsaturated 5 to 6 membered heteromonocyclyl group containing 1 to 4 nitrogen atoms, for example, pyrrolyl, imidazolyl, pyrazolyl, 2-pyridyl, 3-pyridyl, 4-pyridyl, pyrimidyl, pyrazinyl, pyridazinyl, triazolyl [e.g., 4H-1,2,4-triazolyl, 1H-1,2,3-triazolyl, 2H-1,2,3-triazolyl]; unsaturated 5- to 6-membered heteromonocyclic group containing an oxygen atom, for example, pyranyl, 2-furyl, 3-furyl, etc.; unsaturated 5 to 6-membered heteromonocyclic group containing a sulfur atom, for example, 2-thienyl, 3-thienyl, etc.; unsaturated 5- to 6-membered heteromonocyclic group containing 1 to 2 oxygen atoms and 1 to 3 nitrogen atoms, for example, oxazolyl, isoxazolyl, oxadiazolyl [e.g., 1,2,4-oxadiazolyl, 1,3,4-oxadiazolyl, 1,2,5-oxadiazolyl]; unsaturated 5 to 6-membered heteromonocyclic group containing 1 to 2 sulfur atoms and 1 to 3 nitrogen atoms, for example, thiazolyl, thiadiazolyl [e.g., 1,2,4-thiadiazolyl, 1,3,4-thiadiazolyl, 1,2,5-thiadiazolyl].

The term heterocyclyl, (or heterocyclo) also embraces radicals where heterocyclic radicals are fused/condensed with aryl radicals: unsaturated condensed heterocyclic group containing 1 to 5 nitrogen atoms, for example, indolyl, isoindolyl, indolizinyl, benzimidazolyl, quinolyl, isoquinolyl, indazolyl, benzotriazolyl, tetrazolopyridazinyl [e.g., tetrazolo [1,5-b]pyridazinyl]; unsaturated condensed heterocyclic group containing 1 to 2 oxygen atoms and 1 to 3 nitrogen atoms [e.g. benzoxazolyl, benzoxadiazolyl]; unsaturated condensed heterocyclic group containing 1 to 2 sulfur atoms and 1 to 3 nitrogen atoms [e.g., benzothiazolyl, benzothiadiazolyl]; and saturated, partially unsaturated and unsaturated condensed heterocyclic group containing 1 to 2 oxygen or sulfur atoms [e.g. benzofuryl, benzothienyl, 2,3-dihydro-benzo[1,4]dioxinyl and dihydrobenzofuryl]. Preferred heterocyclic radicals include five to ten membered fused or unfused radicals. More preferred examples of heteroaryl radicals include quinolyl, isoquinolyl, imidazolyl, pyridyl, thienyl, thiazolyl, oxazolyl, furyl and pyrazinyl. Other preferred heteroaryl radicals are 5- or 6-membered heteroaryl, containing one or two heteroatoms selected from sulfur, nitrogen and oxygen, selected from thienyl, furyl, pyrrolyl, indazolyl, pyrazolyl, oxazolyl, triazolyl, imidazolyl, pyrazolyl, isoxazolyl, isothiazolyl, pyridyl, piperidinyl and pyrazinyl.

Particular examples of non-nitrogen containing heteroaryl include pyranyl, 2-furyl, 3-furyl, 2-thienyl, 3-thienyl, benzofuryl, and benzothienyl, and the like.

Particular examples of partially saturated and saturated heterocyclyl include pyrrolidinyl, imidazolidinyl, piperidinyl, pyrrolinyl, pyrazolidinyl, piperazinyl, morpholinyl, tetrahydropyranyl, thiazolidinyl, dihydrothienyl, 2,3-dihydro-benzo[1,4]dioxanyl, indolinyl, isoindolinyl, dihydrobenzothienyl, dihydrobenzofuryl, isochromanyl, chromanyl, 1,2-dihydroquinolyl, 1,2,3,4-tetrahydro-isoquinolyl, 1,2,3,4-tetrahydro-quinolyl, 2,3,4,4a,9,9a-hexahydro-1H-3-aza-fluorenyl, 5,6,7-trihydro-1,2,4-triazolo[3,4-a]isoquinolyl, 3,4-dihydro-2H-benzo[1,4]oxazinyl, benzo[1,4]dioxanyl, 2,3-dihydro-1H-1A'-benzo[d]isothiazol-6-yl, dihydropyranyl, dihydrofuryl and dihydrothiazolyl, and the like.
The term "heterocyclo" thus encompasses the following ring systems:
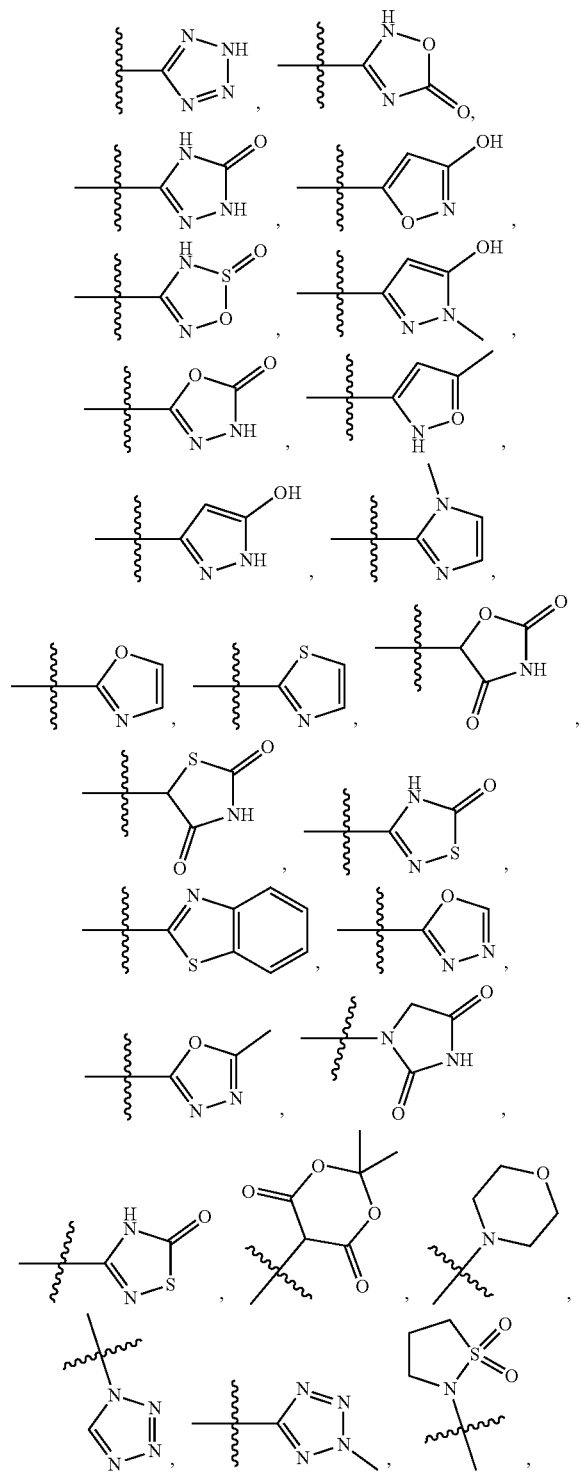
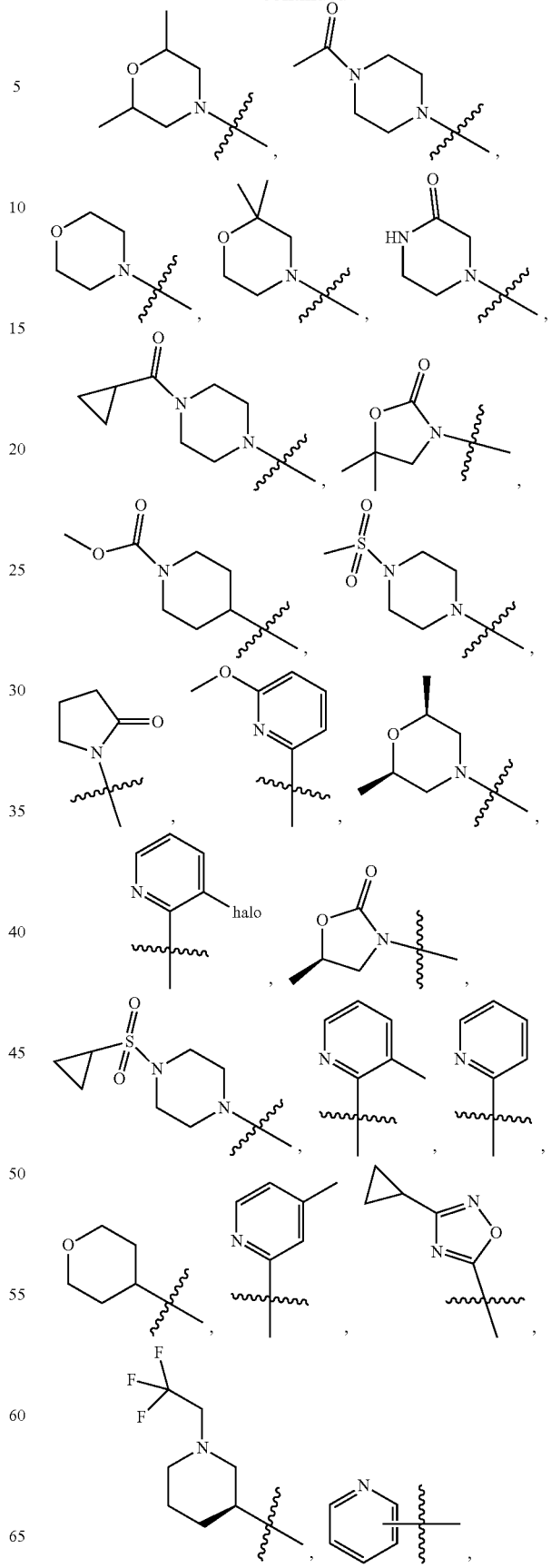

-continued

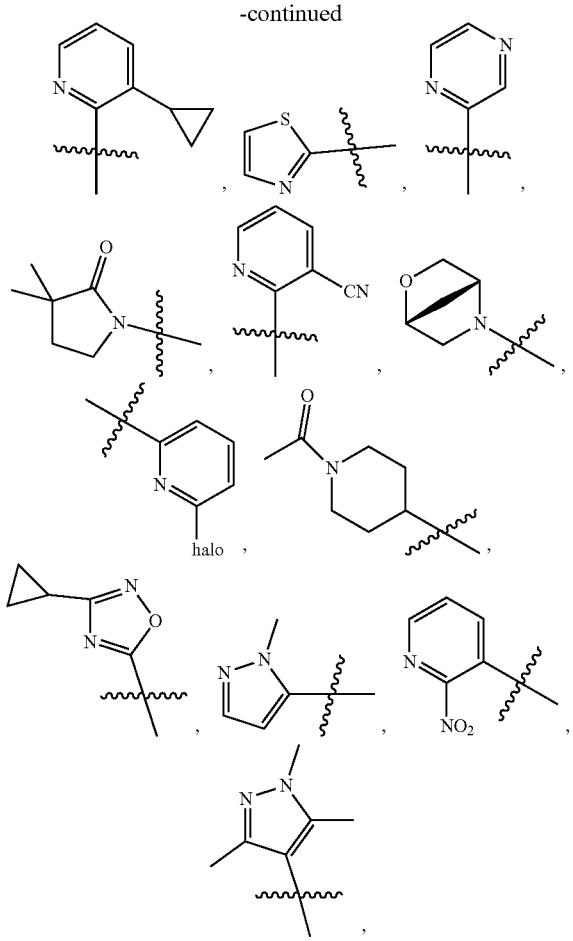

and the like.

The term "carbonyl," whether used alone or with other terms, such as "aminocarbonyl," denotes —(C=O)—.

The terms "heterocyclylalkylenyl" and "heterocyclylalkyl" embrace heterocyclic-substituted alkyl radicals. More preferred heterocyclylalkyl radicals are "5- or 6-membered heteroarylalkyl" radicals having alkyl portions of one to six carbon atoms and a 5- or 6-membered heteroaryl radical. Even more preferred are lower heteroarylalkylenyl radicals having alkyl portions of one to three carbon atoms. Examples include such radicals as pyridylmethyl and thienylmethyl.

The term "cycloalkyl" includes saturated carbocyclic groups. Preferred cycloalkyl groups include $C_3$-$C_6$ rings. More preferred compounds include, cyclopentyl, cyclopropyl, and cyclohexyl.

The term "cycloalkenyl" includes carbocyclic groups having one or more carbon-carbon double bonds including "cycloalkyldienyl" compounds. Preferred cycloalkenyl groups include $C_3$-$C_6$ rings. More preferred compounds include, for example, cyclopentenyl, cyclopentadienyl, cyclohexenyl and cycloheptadienyl.

The term "lipid" encompasses, without limitation, a biomolecule that is insoluble in water but soluble in organic solvents, being derived from natural sources, and/or being synthetically produced, and nonnatural analogs and derivatives of such a biomolecule. Examples of lipids include, without limitation, compounds otherwise described as "lipid-like" or "lipidoid", and the compounds of Formulae I-XVI. Other examples of lipids include, without limitation, synthetic molecules that comprise natural lipids, their derivatives, and their analogs, even if said synthetic molecules are themselves water-soluble. Other examples of lipids include, without limitation, molecules comprising one or more $C_5$-$C_{20}$ alkyl groups, sterols, fatty acids, and their analogues and derivatives.

By "molecule" is meant a molecular entity (molecule, ion, complex, etc.).

By "RNA molecule" is meant a molecule that comprises RNA.

By "synthetic RNA molecule" is meant an RNA molecule that is produced outside of a cell or that is produced inside of a cell using bioengineering, by way of non-limiting example, an RNA molecule that is produced in an in vitro-transcription reaction, an RNA molecule that is produced by direct chemical synthesis or an RNA molecule that is produced in a genetically-engineered E. coli cell.

By "transfection" is meant contacting a cell with a molecule, wherein the molecule is internalized by the cell.

By "upon transfection" is meant during or after transfection.

By "medium" is meant a solvent or a solution comprising a solvent and a solute, by way of non-limiting example, Dulbecco's Modified Eagle's Medium (DMEM), DMEM+ 10% fetal bovine serum (FBS), saline or water.

By "complexation medium" is meant a medium to which a transfection reagent and a molecule to be transfected are added and in which the transfection reagent associates with the molecule to be transfected.

By "transfection medium" is meant a medium that can be used for transfection, by way of non-limiting example, Dulbecco's Modified Eagle's Medium (DMEM), DMEM/ F12, saline or water.

By "recombinant protein" is meant a protein or peptide that is not produced in animals or humans. Non-limiting examples include human transferrin that is produced in bacteria, human fibronectin that is produced in an in vitro culture of mouse cells, and human serum albumin that is produced in a rice plant.

By "Oct4 protein" is meant a protein that is encoded by the POU5F1 gene, or a natural or engineered variant, family-member, orthologue, fragment or fusion construct thereof, by way of non-limiting example, human Oct4 protein (SEQ ID NO: 8), mouse Oct4 protein, Oct1 protein, a protein encoded by POU5F1 pseudogene 2, a DNA-binding domain of Oct4 protein or an Oct4-GFP fusion protein. In embodiments the Oct4 protein comprises an amino acid sequence that has at least 70% identity with SEQ ID NO: 8, or in other embodiments, at least 75%, 80%, 85%, 90%, or 95% identity with SEQ ID NO: 8. In embodiments, the Oct4 protein comprises an amino acid sequence having from 1 to 20 amino acid insertions, deletions, or substitutions (collectively) with respect to SEQ ID NO: 8. Or in other embodiments, the Oct4 protein comprises an amino acid sequence having from 1 to 15 or from 1 to 10 amino acid insertions, deletions, or substitutions (collectively) with respect to SEQ ID NO: 8.

By "Sox2 protein" is meant a protein that is encoded by the Sox2 gene, or a natural or engineered variant, family-member, orthologue, fragment or fusion construct thereof, by way of non-limiting example, human Sox2 protein (SEQ ID NO: 9), mouse Sox2 protein, a DNA-binding domain of Sox2 protein or a Sox2-GFP fusion protein. In embodiments the Sox2 protein comprises an amino acid sequence that has at least 70% identity with SEQ ID NO: 9, or in other embodiments, at least 75%, 80%, 85%, 90%, or 95% identity with SEQ ID NO: 9. In embodiments, the Sox2 protein comprises an amino acid sequence having from 1 to 20 amino acid insertions, deletions, or substitutions (collectively) with respect to SEQ ID NO: 9. Or in other embodiments, the Sox2 protein comprises an amino acid sequence having from 1 to 15 or from 1 to 10 amino acid insertions, deletions, or substitutions (collectively) with respect to SEQ ID NO: 9.

By "Klf4 protein" is meant a protein that is encoded by the KLF4 gene, or a natural or engineered variant, family-member, orthologue, fragment or fusion construct thereof, by way of non-limiting example, human Klf4 protein (SEQ ID NO: 10), mouse Klf4 protein, a DNA-binding domain of Klf4 protein or a Klf4-GFP fusion protein. In embodiments the Klf4 protein comprises an amino acid sequence that has at least 70% identity with SEQ ID NO: 10, or in other embodiments, at least 75%, 80%, 85%, 90%, or 95% identity with SEQ ID NO: 10. In embodiments, the Klf4 protein comprises an amino acid sequence having from 1 to 20 amino acid insertions, deletions, or substitutions (collectively) with respect to SEQ ID NO: 10. Or in other embodiments, the Klf4 protein comprises an amino acid sequence having from 1 to 15 or from 1 to 10 amino acid insertions, deletions, or substitutions (collectively) with respect to SEQ ID NO: 10.

By "c-Myc protein" is meant a protein that is encoded by the MYC gene, or a natural or engineered variant, family-member, orthologue, fragment or fusion construct thereof, by way of non-limiting example, human c-Myc protein (SEQ ID NO: 11), mouse c-Myc protein, I-Myc protein, c-Myc (T58A) protein, a DNA-binding domain of c-Myc protein or a c-Myc-GFP fusion protein. In embodiments the c-Myc protein comprises an amino acid sequence that has at least 70% identity with SEQ ID NO: 11, or in other embodiments, at least 75%, 80%, 85%, 90%, or 95% identity with SEQ ID NO: 11. In embodiments, the c-Myc protein comprises an amino acid having from 1 to 20 amino acid insertions, deletions, or substitutions (collectively) with respect to SEQ ID NO: 11. Or in other embodiments, the c-Myc protein comprises an amino acid sequence having from 1 to 15 or from 1 to 10 amino acid insertions, deletions, or substitutions (collectively) with respect to SEQ ID NO: 11.

By "reprogramming" is meant causing a change in the phenotype of a cell, by way of non-limiting example, causing a β-cell progenitor to differentiate into a mature β-cell, causing a fibroblast to dedifferentiate into a pluripotent stem cell, causing a keratinocyte to transdifferentiate into a cardiac stem cell, causing the telomeres of a cell to lengthen or causing the axon of a neuron to grow.

By "reprogramming factor" is meant a molecule that, when a cell is contacted with the molecule and/or the cell expresses the molecule, can, either alone or in combination with other molecules, cause reprogramming, by way of non-limiting example, Oct4 protein, Tert protein, or erythropoietin.

By "germ cell" is meant a sperm cell or an egg cell.

By "pluripotent stem cell" is meant a cell that can differentiate into cells of all three germ layers (endoderm, mesoderm, and ectoderm) in vivo.

By "somatic cell" is meant a cell that is not a pluripotent stem cell or a germ cell, by way of non-limiting example, a skin cell.

By "hematopoietic cell" is meant a blood cell or a cell that can differentiate into a blood cell, by way of non-limiting example, a hematopoietic stem cell, or a white blood cell.

By "cardiac cell" is meant a heart cell or a cell that can differentiate into a heart cell, by way of non-limiting example, a cardiac stem cell, or a cardiomyocyte.

By "retinal cell" is meant a cell of the retina or a cell that can differentiate into a cell of the retina, by way of non-limiting example, a retinal pigmented epithelial cell.

By "skin cell" is meant a cell that is normally found in the skin, by way of non-limiting example, a fibroblast, a keratinocyte, a melanocyte, an adipocyte, a mesenchymal stem cell, an adipose stem cell or a blood cell.

By "immunosuppressant" is meant a substance that can suppress one or more aspects of an immune system, and that is not normally present in a mammal, by way of non-limiting example, B18R or dexamethasone.

By "single-strand break" is meant a region of single-stranded or double-stranded DNA in which one or more of the covalent bonds linking the nucleotides has been broken in one of the one or two strands.

By "double-strand break" is meant a region of double-stranded DNA in which one or more of the covalent bonds linking the nucleotides has been broken in each of the two strands.

By "nucleotide" is meant a nucleotide or a fragment or derivative thereof, by way of non-limiting example, a nucleobase, a nucleoside, a nucleotide-triphosphate, etc.

By "nucleoside" is meant a nucleotide or a fragment or derivative thereof, by way of non-limiting example, a nucleobase, a nucleoside, a nucleotide-triphosphate, etc.

By "gene editing" is meant altering the DNA sequence of a cell, by way of non-limiting example, by transfecting the cell with a protein that causes a mutation in the DNA of the cell or by transfecting the cell with a protein that causes a chemical change in the DNA of the cell.

By "gene-editing protein" is meant a protein that can, either alone or in combination with one or more other molecules, alter the DNA sequence of a cell, by way of non-limiting example, a nuclease, a transcription activator-like effector nuclease (TALEN), a zinc-finger nuclease, a meganuclease, a nickase, a gene-editing protein disclosed in WO2014/071219A1, the entirety of which is incorporated herein by reference, a clustered regularly interspaced short palindromic repeat (CRISPR)-associated protein, a DNA-repair protein, a DNA-modification protein, a base-modification protein, a DNA methyltransferase, an protein that causes DNA demethylation, an enzyme for which DNA is a substrate or a natural or engineered variant, family-member, orthologue, domain, fragment or fusion construct thereof.

By "repair template" is meant a nucleic acid containing a region of at least about 70% homology with a sequence that is within 10 kb of a target site of a gene-editing protein.

By "repeat sequence" is meant an amino-acid sequence that is present in more than one copy in a protein, to within at least about 10% homology, by way of non-limiting example, a monomer repeat of a transcription activator-like effector.

By "DNA-binding domain" is meant a region of a molecule that is capable of binding to a DNA molecule, by way of non-limiting example, a protein domain comprising one or more zinc fingers, a protein domain comprising one or more transcription activator-like (TAL) effector repeat sequences or a binding pocket of a small molecule that is capable of binding to a DNA molecule.

By "binding site" is meant a nucleic-acid sequence that is capable of being recognized by a gene-editing protein, DNA-binding protein, DNA-binding domain or a biologically active fragment or variant thereof or a nucleic-acid sequence for which a gene-editing protein, DNA-binding protein, DNA-binding domain or a biologically active fragment or variant thereof has high affinity, by way of non-limiting example, an about 20-base-pair sequence of DNA in exon 1 of the human BIRC5 gene.

By "target" is meant a nucleic acid that contains a binding site.

By "liposome" is meant an entity containing amphiphilic molecules, hydrophobic molecules, or a mixture thereof, that is at least transiently stable in an aqueous environment, by way of non-limiting example, a micelle, a unilamellar bilayer with aqueous interior, a multilamellar bilayer, a lipid nanoparticle, any of the foregoing complexed with one or more nucleic acids, or a stable nucleic acid lipid particle.

By "PEGylated" is meant covalently or otherwise stably bound to a poly(ethylene glycol) chain of any length or any molecular weight.

LIPOFECTIN is a 1:1 (w/w) mixture of N-[1-(2,3-dioleyloxy)propyl]-N,N,N-trimethylammonium chloride (DOTMA) and dioleoylphosphatidylethanolamine (DOPE).

LIPOFECTAMINE is a 3:1 (w/w) mixture of the polycationic lipid, 2,3-dioleyloxy-N-[2(sperminecarboxamido)ethyl]-N,N-dimethyl-1-propanaminium trifluoroacetate (DOSPA), and DOPE.

LIPOFECTAMINE 2000 is a 2:3 mixture of the polycationic lipid $N^1,N^4$-dimyristyl-$N^1,N^4$-di-(2-hydroxy-3-aminopropyl)-diaminobutane (DHDMS), and cholesterol.

LIPOFECTAMINE 3000 is a 1:1 mixture of the polycationic lipid (DHDMS), and dioleoylphosphatidylethanolamine (DOPE).

By "DLinDHS" or "DHDLinS" is meant $N^1,N^4$-dilinoleyl-$N^1,N^4$-di-(2-hydroxy-3-aminopropyl)-diaminobutane.

This invention is further illustrated by the following non-limiting examples.

NUMBERED EMBODIMENTS

Embodiment 1: A Compound of Formula (I)

$$A_1 \!-\! (Q_1 \!-\! L_1)_x \!-\! Q_2 \!-\! L_2)_y \!-\! Q_3 \!-\! L_3 \!-\! Q_4)_z \!-\! A_2$$

with substituents $R_1, R_2$ on $Q_1$; $R_3, R_4$ on $Q_2$; $R_5, R_6$ on $Q_3$; $R_7, R_8$ on $Q_4$ (I)

wherein: $Q_1, Q_2, Q_3$, and $Q_4$ are independently an atom or group capable of adopting a positive charge;

$A_1$ and $A_2$ are independently null, H, or optionally substituted $C_1$-$C_6$ alkyl;

$L_1, L_2$, and $L_3$ are independently null, a bond, $(C_1$-$C_{20})$ alkanediyl, (halo)$(C_1$-$C_{20})$alkanediyl, (hydroxy)$(C_1$-$C_{20})$alkanediyl, (alkoxy)$(C_1$-$C_{20})$alkanediyl, arylene, heteroarylene, cycloalkanediyl, heterocycle-diyl, or any combination of the aforementioned optionally linked by one or more of an ether, an ester, an anhydride, an amide, a carbamate, a secondary amine, a tertiary amine, a quaternary ammonium, a thioether, a urea, a carbonyl, or an imine;

$R_1, R_2, R_3, R_4, R_5, R_6, R_7$, and $R_8$ are independently null, H, $(C_1$-$C_{60})$alkyl, (halo)$(C_1$-$C_{60})$alkyl, (hydroxy)$(C_1$-$C_{60})$alkyl, (alkoxy)$(C_1$-$C_{60})$alkyl, $(C_2$-$C_{60})$alkenyl, (halo)$(C_2$-$C_{60})$alkenyl, (hydroxy)$(C_2$-$C_{60})$alkenyl, (alkoxy)$(C_2$-$C_{60})$alkenyl, $(C_2$-$C_{60})$alkynyl, (halo)$(C_2$-$C_{60})$alkynyl, (hydroxy)$(C_2$-$C_{60})$alkynyl, (alkoxy)$(C_2$-$C_{60})$alkynyl, wherein at least one of $R_1, R_2, R_3, R_4, R_5, R_6, R_7$, and $R_8$ comprises at least two unsaturated bonds; and x, y, and z are independently 0, 1, 2, 3, 4, 5, 6, 7, 8, 9, 10, 11, 12, 13, 14, or 15.

Embodiment 2: The compound of embodiment 1, wherein $Q_1, Q_2, Q_3$, and $Q_4$ independently are N, B, P, or Fe.

Embodiment 3: The compound of embodiment 2, wherein $Q_1, Q_2, Q_3$, and $Q_4$ are N.

Embodiment 4: The compound of embodiment 3, wherein $Q_1, Q_2, Q_3$, and $Q_4$ are independently a primary amine, a secondary amine, or a tertiary amine.

Embodiment 5: The compound of embodiment 4, wherein $Q_1$ and $Q_4$ are primary amines, and $Q_2$ and $Q_3$ are tertiary amines.

Embodiment 6: The compound of embodiment 1, wherein $L_1, L_2$, and $L_3$ are independently $(C_1$-$C_6)$alkanediyl or (hydroxy)$(C_1$-$C_6)$alkanediyl.

Embodiment 7: The compound of embodiment 6, wherein $L_1$ and $L_3$ are independently (hydroxy)$(C_1$-$C_6)$alkanediyl and $L_2$ is $(C_1$-$C_6)$alkanediyl.

Embodiment 8: The compound of embodiment 7, wherein $L_1$ and $L_3$ are 2-hydroxypropanediyl and $L_2$ is $(C_1$-$C_6)$ alkanediyl.

Embodiment 9: The compound of embodiment 8, wherein $L_1$ and $L_3$ are 2-hydroxypropanediyl and $L_2$ is butanediyl.

Embodiment 10: The compound of embodiment 1, wherein one or more of $R_1, R_2, R_3, R_4, R_5, R_6, R_7$, and $R_8$ are independently selected from H, linoleyl, alpha-linolenyl, gamma-linolenyl, linoelaidyl, arachidonyl, eicosapentaenyl, and docosahexaenyl.

Embodiment 11: The compound of embodiment 1, wherein two or more of $R_1, R_2, R_3, R_4, R_5, R_6, R_7$, and $R_8$ are independently selected from H, linoleoyl, alpha-linolenoyl, gamma-linolenoyl, linoelaidoyl, arachidonoyl, eicosapentaenoyl, and docosahexaenoyl.

Embodiment 12: The compound of embodiment 1, wherein one or more of $R_1, R_2, R_3, R_4, R_5, R_6, R_7$, and $R_8$ are independently selected from H, myristoleyl, palmitoleyl, sapienyl, oleyl, elaidyl, vaccenyl, erucyl, caprylyl, capryl, lauryl, myristyl, palmityl, stearyl, arachidyl, behenyl, lignoceryl, and cerotyl.

Embodiment 13: The compound of embodiment 1, wherein two or more of $R_1, R_2, R_3, R_4, R_5, R_6, R_7$, and $R_8$ are independently selected from H, myristoleoyl, palmitoleoyl, sapienoyl, oleoyl, elaidoyl, vaccenoyl, erucoyl, capryloyl, caproyl, lauroyl, myristoyl, palmitoyl, stearoyl, arachidoyl, behenoyl, lignoceroyl, and cerotoyl.

Embodiment 14: The compound of embodiment 10, wherein $R_1, R_2, R_3, R_5, R_7$ and $R_8$ are H and $R_4$ and $R_6$ are independently selected from linoleyl, alpha-linolenyl, gamma-linolenyl, linoelaidyl, arachidonyl, eicosapentaenyl, and docosahexaenyl.

Embodiment 15: The compound of embodiment 14, wherein $R_1, R_2, R_3, R_5, R_7$ and $R_8$ are H and $R_4$ and $R_6$ are alpha-linolenyl.

Embodiment 16: The compound of embodiment 14, wherein $R_1, R_2, R_3, R_5, R_7$ and $R_8$ are H and $R_4$ and $R_6$ are linoleyl.

Embodiment 17: The compound of embodiment 1, wherein x and z are independently 0 or 1, and y is 1.

Embodiment 18: The compound of embodiment 1, wherein $Q_1$ and $Q_4$ are primary amines; $Q_2$ and $Q_3$ are tertiary amines; $L_1$ and $L_3$ are 2-hydroxypropanediyl; $L_2$ is butanediyl; $R_1, R_2, R_3, R_5, R_7$ and $R_8$ are H and $R_4$ and $R_6$ are linoleyl; and x, y, and z are 1.

Embodiment 19: The compound of embodiment 1, wherein one or more of $L_1$, $L_2$, and $L_3$ comprises at least one ester moiety.

Embodiment 20: The compound of embodiment 1, wherein one or more of $R_2$ and $R_4$ comprises at least one ester moiety.

Embodiment 21: The compound of embodiment 1, wherein $A_1$ and $A_2$ are H.

Embodiment 22: A compound of Formula (II)

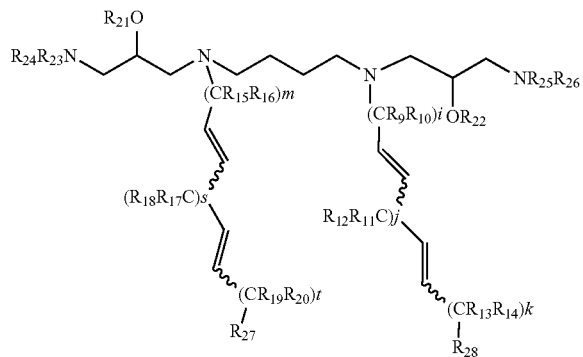

wherein: $R_9$, $R_{10}$, $R_{11}$, $R_{12}$, $R_{13}$, $R_{14}$, $R_{15}$, $R_{16}$, $R_{17}$, $R_{18}$, $R_{19}$, $R_{20}$, $R_{21}$, $R_{22}$, $R_{23}$, $R_{24}$, $R_{25}$, $R_{26}$, $R_{27}$, and $R_{28}$ are independently H, halo, OH, $(C_1-C_6)$alkyl, (halo)($C_1$-$C_6$)alkyl, (hydroxy)($C_1$-$C_6$)alkyl, (alkoxy)($C_1$-$C_6$)alkyl, aryl, heteroaryl, cycloalkyl, or heterocyclo;

i, j, k, m, s, and t are independently 0, 1, 2, 3, 4, 5, 6, 7, 8, 9, 10, 11, 12, 13, 14, or 15.

Embodiment 23: The compound of embodiment 22, wherein $R_{15}$, $R_{16}$, $R_{17}$, $R_{18}$, $R_{19}$, and $R_{20}$ are H; $R_9$, $R_{10}$, $R_{11}$, $R_{12}$, $R_{13}$ and $R_{14}$ are independently H or $(C_1-C_6)$alkyl; m is 8; i is 8; s is 1; j is 1; k is 4; and t is 4.

Embodiment 24: The compound of embodiment 22, wherein $R_{15}$, $R_{16}$, $R_{17}$, $R_{18}$, $R_{19}$, and $R_{20}$ are H; $R_9$, $R_{10}$, $R_{11}$, $R_{12}$, $R_{13}$ and $R_{14}$ are independently H or $(C_1-C_6)$alkyl; $R_{27}$ and $R_{28}$ are methyl; m is 8; i is 8; s is 1; j is 1; k is 4; and t is 4.

Embodiment 25: The compound of embodiment 22, wherein $R_{15}$, $R_{16}$, $R_{17}$, $R_{18}$, $R_{19}$, and $R_{20}$ are H; $R_9$, $R_{10}$, $R_{11}$, $R_{12}$, $R_{13}$ and $R_{14}$ are independently H; $R_{27}$ and $R_{28}$ are methyl; m is 8; i is 8; s is 1; j is 1; k is 4; and t is 4.

Embodiment 26: The compound of embodiment 22, wherein $R_{15}$, $R_{16}$, $R_{17}$, $R_{18}$, $R_{19}$, and $R_{20}$ are H; $R_9$, $R_{10}$, $R_{11}$, $R_{12}$, $R_{13}$ and $R_{14}$ are independently H; $R_{27}$ and $R_{28}$ are methyl; $R_{21}$, $R_{22}$, $R_{23}$, $R_{24}$, $R_{25}$, and $R_{26}$ are H; m is 8; i is 8; s is 1; j is 1; k is 4; and t is 4.

Embodiment 27: The compound of embodiment 22, wherein $R_{15}$, $R_{16}$, $R_{17}$, $R_{18}$, $R_{19}$, and $R_{20}$ are H; $R_9$, $R_{10}$, $R_{11}$, $R_{12}$, $R_{13}$ and $R_{14}$ are independently H; $R_{27}$ and $R_{28}$ are methyl; $R_{21}$, $R_{22}$, $R_{23}$, $R_{24}$, $R_{25}$, and $R_{26}$ are H; m is 9; i is 9; s is 1; j is 1; k is 4; and t is 4.

Embodiment 28: The compound of embodiment 22, wherein $R_{15}$, $R_{16}$, $R_{17}$, $R_{18}$, $R_{19}$, and $R_{20}$ are H; $R_9$, $R_{10}$, $R_{11}$, $R_{12}$, $R_{13}$ and $R_{14}$ are independently H; $R_{27}$ and $R_{28}$ are methyl; $R_{21}$, $R_{22}$, $R_{23}$, $R_{24}$, $R_{25}$, and $R_{26}$ are H; m is 9; i is 9; s is 1; j is 1; k is 3; and t is 3.

Embodiment 29: A compound of Formula (III):

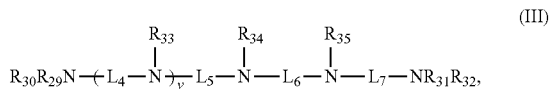

wherein $L_4$, $L_5$, $L_6$, and $L_7$ are independently a bond, $(C_1-C_{20})$alkanediyl, (halo)($C_1$-$C_{20}$)alkanediyl, (hydroxy)($C_1$-$C_{20}$)alkanediyl, (alkoxy)($C_1$-$C_{20}$)alkanediyl, arylene, heteroarylene, cycloalkanediyl, heterocycle-diyl, $-(CH_2)_{v1}-C(O)-$, $-((CH_2)_{v1}-O)_{v2}-$, or $-((CH_2)_{v1}-C(O)-O)_{v2}-$;

$R_{29}$, $R_{30}$, $R_{31}$, $R_{32}$, $R_{33}$, $R_{34}$, and $R_{35}$ are independently H, $(C_1-C_{60})$alkyl, (halo)($C_1$-$C_{60}$)alkyl, (hydroxy)($C_1$-$C_{60}$)alkyl, (alkoxy)($C_1$-$C_{60}$)alkyl, $(C_2-C_{60})$alkenyl, (halo)($C_2$-$C_{60}$)alkenyl, (hydroxy)($C_2$-$C_{60}$)alkenyl, (alkoxy)($C_2$-$C_{60}$)alkenyl, $(C_2-C_{60})$alkynyl, (halo)($C_2$-$C_{60}$)alkynyl, (hydroxy)($C_2$-$C_{60}$)alkynyl, (alkoxy)($C_2$-$C_{60}$)alkynyl, wherein at least one of $R_{29}$, $R_{30}$, $R_{31}$, $R_{32}$, $R_{33}$, $R_{34}$, and $R_{35}$ comprises at least two unsaturated bonds;

v, $v_1$ and $v_2$ are independently 0, 1, 2, 3, 4, 5, 6, 7, 8, 9, 10, 11, 12, 13, 14, or 15.

Embodiment 30: The compound of embodiment 29, wherein $L_4$, $L_5$, $L_6$, and $L_7$ are $-(CH_2)_3-$; $R_{29}$, $R_{30}$, $R_{31}$, $R_{32}$, $R_{33}$, $R_{34}$, and $R_{35}$ are independently H or $(C_2-C_{60})$alkenyl; v is 1; wherein at least two of $R_{29}$, $R_{30}$, $R_{31}$, $R_{32}$, $R_{33}$, $R_{34}$, and $R_{35}$ comprise at least two unsaturated bonds.

Embodiment 31: The compound of embodiment 29, wherein $L_4$ and $L_5$ are $-(CH_2)_3-$; $L_6$ and $L_7$ are $-(CH_2)_4-$; $R_{29}$, $R_{30}$, $R_{31}$, $R_{32}$, $R_{33}$, $R_{34}$, and $R_{35}$ are independently H or $(C_2-C_{60})$alkenyl; v is 1; wherein at least two of $R_{29}$, $R_{30}$, $R_{31}$, $R_{32}$, $R_{33}$, $R_{34}$, and $R_{35}$ comprise at least two unsaturated bonds.

Embodiment 32: The compound of embodiment 29, wherein $L_4$ and $L_6$ are $-(CH_2)_3-$; $L_5$ and $L_7$ are $-(CH_2)_4-$; $R_{29}$, $R_{30}$, $R_{31}$, $R_{32}$, $R_{33}$, $R_{34}$, and $R_{35}$ are independently H or $(C_2-C_{60})$alkenyl; v is 1; wherein at least two of $R_{29}$, $R_{30}$, $R_{31}$, $R_{32}$, $R_{33}$, $R_{34}$, and $R_{35}$ comprise at least two unsaturated bonds.

Embodiment 33: The compound of embodiment 29, wherein $L_4$ and $L_7$ are $-(CH_2)_3-$; $L_5$ and $L_6$ are $-(CH_2)_4-$; $R_{29}$, $R_{30}$, $R_{31}$, $R_{32}$, $R_{33}$, $R_{34}$, and $R_{35}$ are independently H or $(C_2-C_{60})$alkenyl; v is 1; wherein at least two of $R_{29}$, $R_{30}$, $R_{31}$, $R_{32}$, $R_{33}$, $R_{34}$, and $R_{35}$ comprise at least two unsaturated bonds.

Embodiment 34: The compound of embodiment 29, wherein $L_4$ and $L_6$ are $-(CH_2)_3-$; $L_5$ and $L_7$ are $-(CH_2)_5-$; $R_{29}$, $R_{30}$, $R_{31}$, $R_{32}$, $R_{33}$, $R_{34}$, and $R_{35}$ are independently H or $(C_2-C_{60})$alkenyl; v is 1; wherein at least two of $R_{29}$, $R_{30}$, $R_{31}$, $R_{32}$, $R_{33}$, $R_{34}$, and $R_{35}$ comprise at least two unsaturated bonds.

Embodiment 35: The compound of embodiment 29, wherein $L_4$ and $L_7$ are (hydroxy)($C_1$-$C_{20}$)alkanediyl; $L_5$ and $L_6$ are $-(CH_2)_3-$, $R_{29}$, $R_{30}$, $R_{31}$, $R_{32}$, $R_{33}$, $R_{34}$, and $R_{35}$ are independently H or $(C_2-C_{60})$alkenyl; v is 1; wherein at least two of $R_{29}$, $R_{30}$, $R_{31}$, $R_{32}$, $R_{33}$, $R_{34}$, and $R_{35}$ comprise at least two unsaturated bonds.

Embodiment 36: The compound of embodiment 29, wherein $L_4$ and $L_7$ are (hydroxy)($C_1$-$C_{20}$)alkanediyl; $L_5$ and $L_6$ are $-(CH_2)_3-$; $R_{29}$, $R_{30}$, $R_{31}$, $R_{32}$, $R_{33}$, $R_{34}$, and $R_{35}$ are independently H or $(C_2-C_{60})$alkenyl; v is 1; wherein at least three of $R_{29}$, $R_{30}$, $R_{31}$, $R_{32}$, $R_{33}$, $R_{34}$, and $R_{35}$ comprise at least two unsaturated bonds.

Embodiment 37: The compound of embodiment 29, wherein $L_4$ and $L_7$ are (hydroxy)($C_1$-$C_{20}$)alkanediyl; $L_5$ and $L_6$ are —($CH_2$)$_4$—; $R_{29}$, $R_{30}$, $R_{31}$, $R_{32}$, $R_{33}$, $R_{34}$, and $R_{35}$ are independently H or ($C_2$-$C_{60}$)alkenyl; v is 1; wherein at least three of $R_{29}$, $R_{30}$, $R_{31}$, $R_{32}$, $R_{33}$, $R_{34}$, and $R_{35}$ comprise at least two unsaturated bonds.

Embodiment 38: The compound of embodiment 29, wherein $L_4$ and $L_7$ are (hydroxy)($C_1$-$C_{20}$)alkanediyl; $L_5$ and $L_6$ are —($CH_2$)$_5$—; $R_{29}$, $R_{30}$, $R_{31}$, $R_{32}$, $R_{33}$, $R_{34}$, and $R_{35}$ are independently H or ($C_2$-$C_{60}$)alkenyl; v is 1; wherein at least three of $R_{29}$, $R_{30}$, $R_{31}$, $R_{32}$, $R_{33}$, $R_{34}$, and $R_{35}$ comprise at least two unsaturated bonds.

Embodiment 39: The compound of embodiment 29, wherein $L_4$ and $L_7$ are (hydroxy)($C_1$-$C_{20}$)alkanediyl; $L_5$ and $L_6$ are —($CH_2$)$_6$—; $R_{29}$, $R_{30}$, $R_{31}$, $R_{32}$, $R_{33}$, $R_{34}$, and $R_{35}$ are independently H or ($C_2$-$C_{60}$)alkenyl; v is 1; wherein at least three of $R_{29}$, $R_{30}$, $R_{31}$, $R_{32}$, $R_{33}$, $R_{34}$, and $R_{35}$ comprise at least two unsaturated bonds.

Embodiment 40: The compound of embodiment 29, wherein two or more of $R_{29}$, $R_{30}$, $R_{31}$, $R_{32}$, $R_{33}$, $R_{34}$, and $R_{35}$ are independently selected from H, myristoleoyl, palmitoleoyl, sapienoyl, oleoyl, elaidoyl, vaccenoyl, erucoyl, capryloyl, caproyl, lauroyl, myristoyl, palmitoyl, stearoyl, arachidoyl, behenoyl, lignoceroyl, and cerotoyl.

Embodiment 41: The compound of embodiment 29, wherein two or more of $R_{29}$, $R_{30}$, $R_{31}$, $R_{32}$, $R_{33}$, $R_{34}$, and $R_{35}$ are independently selected from H, linoleyl, alpha-linolenyl, gamma-linolenyl, linoelaidyl, arachidonyl, eicosapentaenyl, and docosahexaenyl.

Embodiment 42: The compound of embodiment 29, wherein $L_4$ and $L_7$ are 2-hydroxypropanediyl; $L_2$ is butanediyl; $R_{29}$, $R_{30}$, $R_{31}$, and $R_{32}$ are H, $R_{33}$, $R_{34}$, and $R_{35}$ are linoleyl; $L_5$ and $L_6$ are —($CH_2$)$_3$—; and v is 1.

Embodiment 43: The compound of embodiment 29, wherein $L_4$ and $L_7$ are 2-hydroxypropanediyl; $L_2$ is butanediyl; $R_{29}$, $R_{30}$, $R_{31}$, and $R_{32}$ are H, $R_{33}$, $R_{34}$, and $R_{35}$ are linoleyl; $L_5$ and $L_6$ are —($CH_2$)$_4$—; and v is 1.

Embodiment 44: The compound of embodiment 29, wherein $L_4$ and $L_7$ are 2-hydroxypropanediyl; $L_2$ is butanediyl; $R_{29}$, $R_{30}$, $R_{31}$, and $R_{32}$ are H, $R_{33}$, $R_{34}$, and $R_{35}$ are linoleyl; $L_5$ and $L_6$ are —($CH_2$)$_5$—; and v is 1.

Embodiment 45: The compound of embodiment 29, wherein $L_4$ and $L_7$ are 2-hydroxypropanediyl; $L_2$ is butanediyl; $R_{29}$, $R_{30}$, $R_{31}$, and $R_{32}$ are H, $R_{33}$, $R_{34}$, and $R_{35}$ are linoleyl; $L_5$ and $L_6$ are —($CH_2$)$_6$—; and v is 1.

Embodiment 46: A compound of Formula (IV):

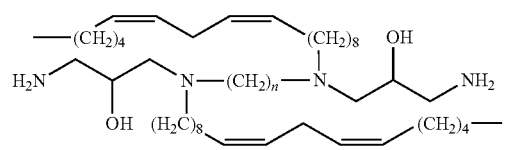

(IV)

wherein n is 1, 2, 3, 4, 5, 6, 7, 8, 9, 10, 11, 12, 13, 14, or 15.

Embodiment 47: A compound of Formula (V):

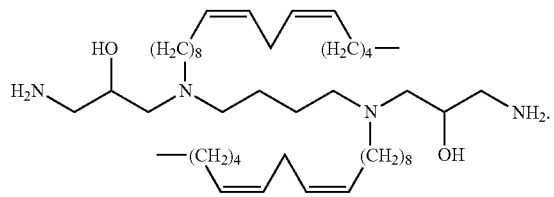

(V)

Embodiment 48: A compound of Formula (VI):

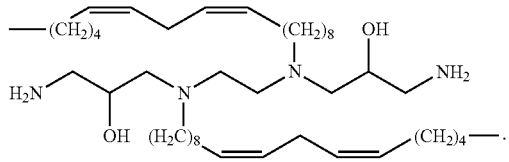

(VI)

Embodiment 49: A compound of Formula (VII):

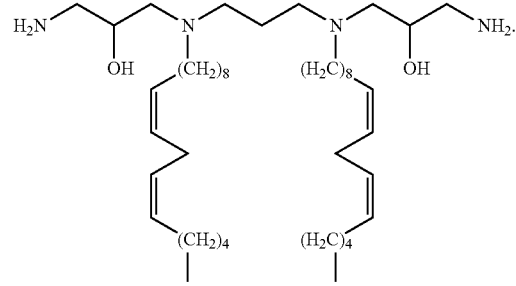

(VII)

Embodiment 50: A compound of Formula (VIM):

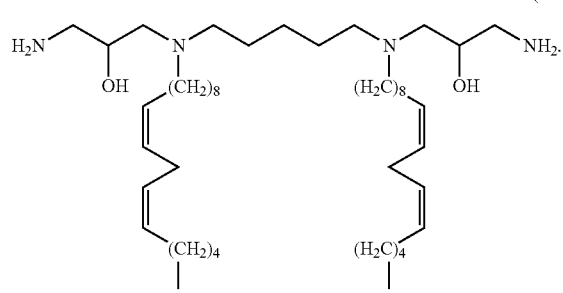

(VIII)

Embodiment 51: A compound of Formula (IX):
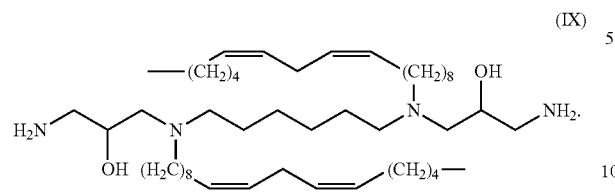
Embodiment 52: A compound of Formula (X):
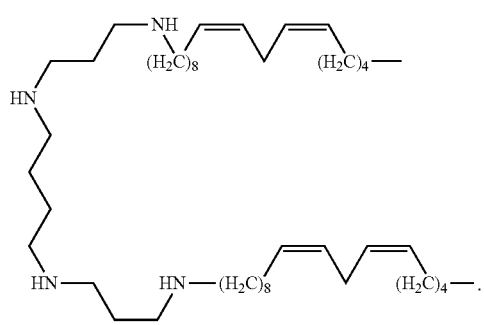
Embodiment 53: A compound of Formula (XI):
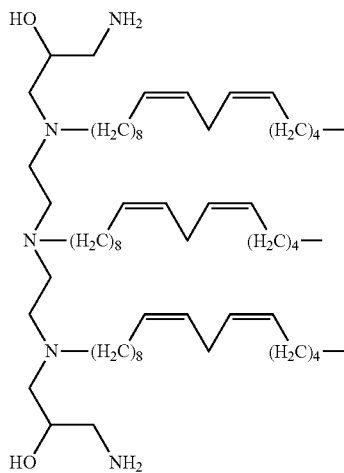
Embodiment 54: A compound of Formula (XII):
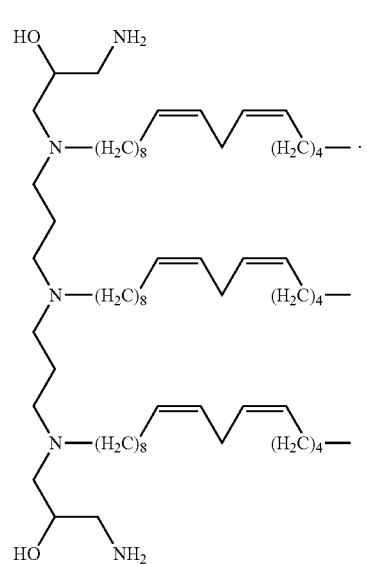
Embodiment 55: A compound of Formula (XIII):
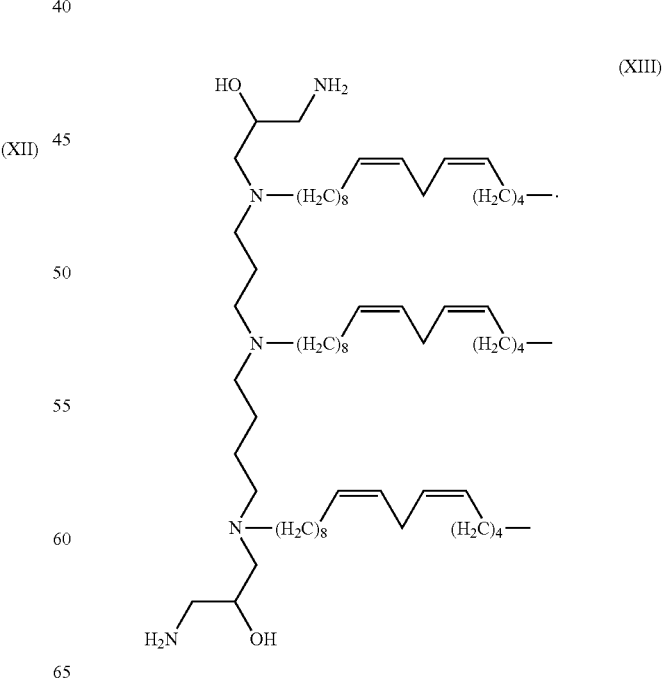

Embodiment 56: A compound of Formula (XIV):

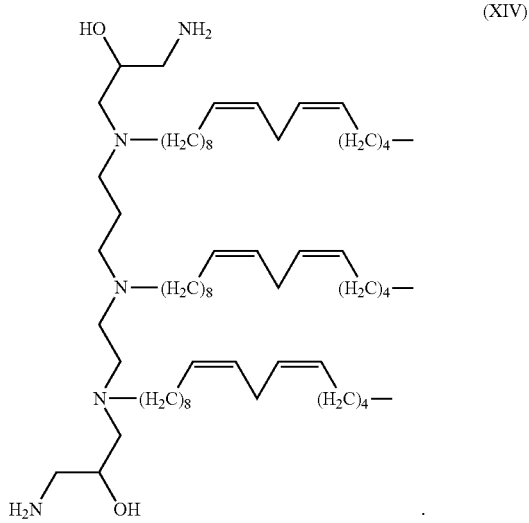

Embodiment 57: A compound of Formula (XV):

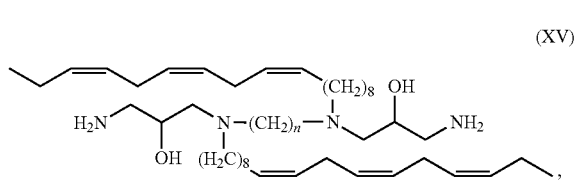

wherein n is 1, 2, 3, 4, 5, 6, 7, 8, 9, 10, 11, 12, 13, 14, or 15.

Embodiment 58: A compound of Formula (XVI):

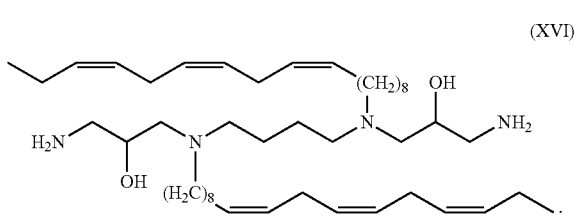

Embodiment 59: A pharmaceutical composition comprising a compound of any one of embodiments 1-58, and a pharmaceutically acceptable carrier or excipient.

Embodiment 60: A lipid aggregate comprising the compound of any one of embodiments 1-58 or the pharmaceutical composition of embodiment 59.

Embodiment 61: The lipid aggregate of embodiment 60, wherein the lipid aggregate does not comprise one or more additional lipids or polymers.

Embodiment 62: The lipid aggregate of embodiment 60, further comprising one or more additional lipids or polymers selected from Table 1.

Embodiment 63: The lipid aggregate of embodiments 60 or 61, wherein the one or more additional lipids is a neutral lipid.

Embodiment 64: The lipid aggregate of embodiment 63, wherein the neutral lipid is dioleoylphosphatidyletha-nolamine (DOPE), 1,2-Dioleoyl-sn-glycero-3-phosphocholine (DOPC), or cholesterol.

Embodiment 65: The lipid aggregate of embodiment 63, wherein the neutral lipid comprises DOPE or cholesterol.

Embodiment 66: The lipid aggregate of embodiment 63, wherein the neutral lipid comprises DOPE and cholesterol.

Embodiment 67: The lipid aggregate of embodiment 63, wherein the compound comprises Formula (IV).

Embodiment 68: The lipid aggregate of any one of embodiments 60-67, wherein the one or more additional lipids is a cationic lipid.

Embodiment 69: The lipid aggregate of embodiment 68, wherein the cationic lipid is N-[1-(2,3-dioleoyloxy)propyl]-N, N, N-trimethylammonium chloride (DOTMA), 1,2-bis(oleoyloxy)-3-3-(trimethylammonia) propane (DOTAP), or 1,2-dioleoyl-3-dimethylammonium-propane (DODAP).

Embodiment 70: The lipid aggregate of any one of embodiments 60-69, further comprising DOTMA and DOPE in a ratio of about 1:1 and/or N1,N4-dioleyl-N1,N4-di-(2-hydroxy-3-aminopropyl)-diaminobutane (DHDOS) and DOPE in a ratio of about 1:1.

Embodiment 71: The lipid aggregate of embodiment 60, further comprising compound having the Formula (A):

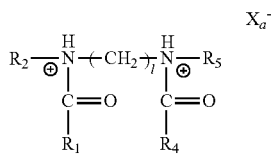

wherein
R1 and R4 are straight-chain alkenyl having 17 carbon atoms;
R2 and R5 are —(CH2)p-NH2 where p is 1-4;
l is 1-10; and
Xa is a physiologically acceptable anion.

Embodiment 72: The compound, pharmaceutical composition, or lipid aggregate of any one of embodiments 1-71, further comprising a PEGylated lipid.

Embodiment 73: The compound, pharmaceutical composition, or lipid aggregate of any one of embodiments 1-72, wherein the Z-average particle size is from about 50 nm to about 2000 nm.

Embodiment 74: The compound, pharmaceutical composition, or lipid aggregate of any one of embodiments 1-72, wherein the Z-average particle size is from about 700 nm to about 1500 nm.

Embodiment 75: The compound, pharmaceutical composition, or lipid aggregate of any one of embodiments 1-72, wherein the Z-average particle size is about 750 nm.

Embodiment 76: The compound, pharmaceutical composition, or lipid aggregate of any one of embodiments 1-72, wherein the Z-average particle size is less than about 200 nm.

Embodiment 77: The compound, pharmaceutical composition, or lipid aggregate of any one of embodiments 1-72, wherein parameters of a medium in which the compound, pharmaceutical composition, or lipid aggregate, is formed, are used to control the Z-average particle size.

Embodiment 78: The compound, pharmaceutical composition, or lipid aggregate of any one of embodiments 1-72, wherein the ionic strength of a medium in which the compound, pharmaceutical composition, or lipid aggregate, is formed, are used to control the Z-average particle size.

Embodiment 79: The compound, pharmaceutical composition, or lipid aggregate of any one of embodiments 1-72, wherein a pH of a medium in which such compound, pharmaceutical composition, or lipid aggregate, is formed, are used to control the Z-average particle size.

Embodiment 80: The compound, pharmaceutical composition, or lipid aggregate of any one of embodiments 1-71, wherein the ionic strength of a medium in which the compound, pharmaceutical composition, or lipid aggregate, is formed, is used to maintain a particle size less than or equal to 200 nm.

Embodiment 81: The compound, pharmaceutical composition, or lipid aggregate of any one of embodiments 1-80, further comprising a stable dispersion of particles.

Embodiment 82: The compound, pharmaceutical composition, or lipid aggregate of embodiment 81, wherein the stable dispersion has a pH from about 7.0 to about 8.0, or a pH of about 7.4.

Embodiment 83: The pharmaceutical composition or lipid aggregate of any one of embodiments 1-82, further comprising insulin, transferrin, and/or albumin.

Embodiment 84: The compound, pharmaceutical composition, or lipid aggregate of any one of embodiments 1-83, further comprising a nucleic acid.

Embodiment 85: The compound, pharmaceutical composition, or lipid aggregate of embodiment 4 wherein the nucleic acid is DNA or RNA.

Embodiment 86: The compound, pharmaceutical composition, or lipid aggregate of embodiment 85, wherein RNA is synthetic RNA.

Embodiment 87: The compound, pharmaceutical composition, or lipid aggregate of embodiment 86, wherein the synthetic RNA does not comprise a non-canonical nucleotide.

Embodiment 88: The compound, pharmaceutical composition, or lipid aggregate of embodiment 86, wherein the synthetic RNA comprises a combination of non-canonical nucleotides that optionally avoid substantial cellular toxicity.

Embodiment 89: The compound, pharmaceutical composition, or lipid aggregate of embodiment 88, wherein the non-canonical nucleotides have one or more substitutions at positions selected from the 2C, 4C, and 5C positions for a pyrimidine, or selected from the 6C, 7N and 8C positions for a purine.

Embodiment 90: The compound, pharmaceutical composition, or lipid aggregate of embodiment 89, wherein the non-canonical nucleotides comprise one or more of 5-hydroxycytidine, 5-methylcytidine, 5-hydroxymethylcytidine, 5-carboxycytidine, 5-formylcytidine, 5-methoxycytidine, pseudouridine, 5-hydroxyuridine, 5-methyluridine, 5-hydroxymethyluridine, 5-carboxyuridine, 5-formyluridine, 5-methoxyuridine, 5-hydroxypseudouridine, 5-methylpseudouridine, 5-hydroxymethylpseudouridine, 5-carboxypseudouridine, 5-formylpseudouridine, and 5-methoxypseudouridine, optionally at an amount of at least 50%, or at least 60%, or at least 70%, or at least 80%, or at least 90%, or 100% of the non-canonical nucleotides.

Embodiment 91: The compound, pharmaceutical composition, or lipid aggregate of embodiment any one of embodiments 88-90, wherein at least about 50% of cytidine residues are non-canonical nucleotides, and which are selected from 5-hydroxycytidine, 5-methylcytidine, 5-hydroxymethylcytidine, 5-carboxycytidine, 5-formylcytidine, and 5-methoxycytidine.

Embodiment 92: The compound, pharmaceutical composition, or lipid aggregate of embodiment any one of embodiments 88-91, wherein at least about 75% or at least about 90% of cytidine residues are non-canonical nucleotides, and the non-canonical nucleotides are selected from 5-hydroxycytidine, 5-methylcytidine, 5-hydroxymethylcytidine, 5-carboxycytidine, 5-formylcytidine, and 5-methoxycytidine.

Embodiment 93: The compound, pharmaceutical composition, or lipid aggregate of embodiment any one of embodiments 88-92, wherein at least about 20% of uridine, or at least about 40%, or at least about 50%, or at least about 75%, or at about least 90% of uridine residues are non-canonical nucleotides, and the non-canonical are selected from pseudouridine, 5-hydroxyuridine, 5-methyluridine, 5-hydroxymethyluridine, 5-carboxyuridine, 5-formyluridine, 5-methoxyuridine, 5-hydroxypseudouridine, 5-methylpseudouridine, 5-hydroxymethylpseudouridine, 5-carboxypseudouridine, 5-formylpseudouridine, and 5-methoxypseudouridine.

Embodiment 94: The compound, pharmaceutical composition, or lipid aggregate of embodiment any one of embodiments 88-93, wherein at least about 40%, or at least about 50%, or at least about 75%, or at about least 90% of uridine residues are non-canonical nucleotides, and the non-canonical nucleotides are selected from pseudouridine, 5-hydroxyuridine, 5-methyluridine, 5-hydroxymethyluridine, 5-carboxyuridine, 5-formyluridine, 5-methoxyuridine, 5-hydroxypseudouridine, 5-methylpseudouridine, 5-hydroxymethylpseudouridine, 5-carboxypseudouridine, 5-formylpseudouridine, and 5-methoxypseudouridine.

Embodiment 95: The compound, pharmaceutical composition, or lipid aggregate of any one of embodiments 88-94, wherein at least about 10% of guanine residues are non-canonical nucleotides, and the non-canonical nucleotide is optionally 7-deazaguanosine.

Embodiment 96: The compound, pharmaceutical composition, or lipid aggregate of any one of embodiments 88-95, wherein the RNA contains no more than about 50% 7-deazaguanosine in place of guanosine residues.

Embodiment 97: The compound, pharmaceutical composition, or lipid aggregate of any one of embodiments 88-96, wherein the RNA does not contain non-canonical nucleotides in place of adenosine residues.

Embodiment 98: The compound, pharmaceutical composition, or lipid aggregate of any one of embodiments 88-97, wherein the RNA comprises a 5' cap structure.

Embodiment 99: The compound, pharmaceutical composition, or lipid aggregate of any one of embodiments 88-98, wherein the RNA 5'-UTR comprises a Kozak consensus sequence.

Embodiment 100: The compound, pharmaceutical composition, or lipid aggregate of any one of embodiments 88-99, wherein the RNA 5'-UTR comprises a sequence that increases RNA stability in vivo, and the 5'-UTR may comprise an alpha-globin or beta-globin 5'-UTR.

Embodiment 101: The compound, pharmaceutical composition, or lipid aggregate of any one of embodiments 88-100, wherein the RNA 3'-UTR comprises a sequence that increases RNA stability in vivo, and the 3'-UTR may comprise an alpha-globin or beta-globin 3'-UTR.

Embodiment 102: The compound, pharmaceutical composition, or lipid aggregate of any one of embodiments 88-101, wherein the synthetic RNA molecule comprises a microRNA binding site, the micro-RNA binding site optionally being: a miR142 micro-RNA binding site (optionally being one of SEQ ID NO: 811 and SEQ ID NO: 812) or a variant thereof and/or present in the 3'-UTR of the synthetic RNA molecule in one or more copies.

Embodiment 103: The compound, pharmaceutical composition, or lipid aggregate of any one of embodiments 88-102, wherein the RNA comprises a 3' poly(A) tail and optionally wherein the RNA 3' poly(A) tail is from about 20 nucleotides to about 250 nucleotides in length.

Embodiment 104: The compound, pharmaceutical composition, or lipid aggregate of any one of embodiments 88-103, wherein the RNA is from about 200 nucleotides to about 5000 nucleotides in length.

Embodiment 105: The compound, pharmaceutical composition, or lipid aggregate of any one of embodiments 88-104, wherein the RNA is from about 500 to about 2000 nucleotides in length, or about 500 to about 1500 nucleotides in length, or about 500 to about 1000 nucleotides in length.

Embodiment 106: The compound, pharmaceutical composition, or lipid aggregate of any one of embodiments 88-105, wherein the RNA is prepared by in vitro transcription.

Embodiment 107: The compound, pharmaceutical composition, or lipid aggregate of any one of embodiments 1-106, wherein the composition is suitable for administration by subcutaneous injection, intradermal injection, subdermal injection, intramuscular injection, intravenous, intrathecal, intratumoral, and topical administration.

Embodiment 108: The compound, pharmaceutical composition, or lipid aggregate of any one of embodiments 1-107, wherein the composition is suitable for administration as one or more injections containing about 1 ng to about 2000 ng of RNA.

Embodiment 109: The compound, pharmaceutical composition, or lipid aggregate of any one of embodiments 88-108, wherein the synthetic RNA is mRNA.

Embodiment 110: The compound, pharmaceutical composition, or lipid aggregate of embodiment 109, wherein the mRNA encodes a protein of interest.

Embodiment 111: The compound, pharmaceutical composition, or lipid aggregate of embodiment 110, wherein the protein of interest is a soluble protein, optionally selected from Table 2B.

Embodiment 112: The compound, pharmaceutical composition, or lipid aggregate of embodiment 111, wherein the soluble protein is one or more reprogramming factors.

Embodiment 113: The compound, pharmaceutical composition, or lipid aggregate of embodiment 112, wherein the wherein the one or more reprogramming factors is selected from Oct4, Sox2, Klf4, c-Myc, l-Myc, Tert, Nanog, Lin28, Utf1, Aicda, miR200 micro-RNA, miR302 micro-RNA, miR367 micro-RNA, miR369 micro-RNA and biologically active fragments, analogues, variants and family-members thereof.

Embodiment 114: The compound, pharmaceutical composition, or lipid aggregate of embodiment 110, wherein the protein of interest is a gene-editing protein.

Embodiment 115: The compound, pharmaceutical composition, or lipid aggregate of embodiment 114, wherein the gene-editing protein is selected from a nuclease, a transcription activator-like effector nuclease (TALEN), a zinc-finger nuclease, a meganuclease, a nickase, a clustered regularly interspaced short palindromic repeat (CRISPR)-associated protein, CRISPR/Cas9, Cas9, xCas9, Cas12a (Cpf1), Cas13a, Cas14, CasX, CasY, a Class 1 Cas protein, a Class 2 Cas protein, and MAD7, or a natural or engineered variant, family-member, orthologue, fragment or fusion construct thereof.

Embodiment 116: The compound, pharmaceutical composition, or lipid aggregate of embodiment 115, wherein the gene-editing protein comprises a DNA-binding domain comprising a plurality of repeat sequences and at least one of the repeat sequences comprises the amino acid sequence: LTPvQWAIAwxyzGHGG (SEQ ID NO: 629) and is between 36 and 39 amino acids long, wherein: "v" is Q, D or E, "w" is S or N, "x" is H, N, or I, "y" is D, A, I, N, G, H, K, S, or null, and "z" is GGKQALETVQRLLPVLCQD (SEQ ID NO: 630) or GGKQALETVQRLLPVLCQA (SEQ ID NO: 631).

Embodiment 117: The compound, pharmaceutical composition, or lipid aggregate of embodiment 116, wherein the gene-editing protein further comprises a nuclease domain comprising a catalytic domain of a nuclease.

Embodiment 118: The compound, pharmaceutical composition, or lipid aggregate of any one of embodiments 114-117, wherein the gene-editing protein is capable of creating a single-strand or double-strand break in the gene.

Embodiment 119: The compound, pharmaceutical composition, or lipid aggregate of embodiment 118, wherein the single-strand or double-strand break causes persistent altered splicing of the gene.

Embodiment 120: The compound, pharmaceutical composition, or lipid aggregate of any one of embodiments 114-119, further comprising a functional copy of the gene.

Embodiment 121: A method for transfecting a cell with a nucleic acid, comprising contacting the cell with a complex of the nucleic acid and a compound, pharmaceutical composition, or lipid aggregate of any of the above embodiments.

Embodiment 122: The method of embodiment 121, wherein the complex is formed prior to contact with the cell.

Embodiment 123: The method of embodiments 121 or 122, wherein the method provides one of the following characteristics: (a) high transfection efficiency, (b) high level of endosomal escape, (c) serum-resistance, low toxicity effects, (d) high level of protein expression, (e) transfectability in various cell types, and (f) transfectability without additional lipids or reagents for transfection.

Embodiment 124: The method of any one of embodiments 121-123, wherein the characteristics are relative to a method of transfecting a cell with complex of the nucleic acid and DOTMA, DOTMA, DODAP, and DOPE, and cholesterol, and combinations thereof.

Embodiment 125: The method of any one of embodiments 121-124, wherein the characteristics are relative to a method of transfecting a cell with complex of the nucleic acid and LIPOFECTIN, LIPOFECTAMINE, LIPOFECTAMINE 2000, LIPOFECTAMINE 3000.

Embodiment 126: A method for reprogramming a differentiated or a non-pluripotent cell to a less differentiated state, comprising: (a) providing a differentiated or a non-pluripotent cell; (b) culturing the differentiated or a non-pluripotent cell; (c) transfecting the differentiated or a non-pluripotent cell with a complex of one or more synthetic RNA molecules and a compound, pharmaceutical composition, or lipid aggregate of any of the above embodiments, wherein the one or more synthetic RNA molecules include at least one RNA molecule encoding one or more reprogramming factors and wherein the transfecting results in the cell expressing the one or more reprogramming factors, to result in the cell being reprogrammed to a less differentiated state.

Embodiment 127: The method of embodiment 126, where step (c) occurs in the presence of a medium containing ingredients that support reprogramming of the differentiated or a non-pluripotent to a less differentiated state.

Embodiment 128: The method of embodiment 126 or 127, further comprising repeating step (c) at least twice during 5 consecutive days.

Embodiment 129: The method of embodiment 128, wherein the amount of one or more synthetic RNA molecules transfected in one or more later transfections is greater than the amount transfected in one or more earlier transfections.

Embodiment 130: The method of any one of embodiments 126-129, wherein steps (a)-(c) are performed without using feeder cells and occur in the presence of a feeder cell conditioned medium.

Embodiment 131: The method of any one of embodiments 126-130, wherein step (c) is performed without using irradiated human neonatal fibroblast feeder cells and occurs in the presence of a feeder cell conditioned medium.

Embodiment 132: The method of any one of embodiments 126-131, wherein the synthetic RNA molecule encodes one or more reprogramming factor(s) selected from Oct4, Sox2, Klf4, c-Myc, 1-Myc, Tert, Nanog, Lin28, Utf1, Aicda, miR200 micro-RNA, miR302 micro-RNA, miR367 micro-RNA, miR369 micro-RNA and biologically active fragments, analogues, variants and family-members thereof.

Embodiment 133: The method of embodiment 126, wherein the differentiated or a non-pluripotent cell is derived from a biopsy.

Embodiment 134: The method of embodiment 126, wherein the differentiated or a non-pluripotent cell is from a human subject.

Embodiment 135: The method of embodiment 126, wherein the differentiated or a non-pluripotent cell is derived from a dermal punch biopsy sample.

Embodiment 136: The method of embodiment 126, wherein the differentiated or a non-pluripotent cell is a skin cell.

Embodiment 137: The method of embodiment 126, further comprising contacting the cell with at least one member of the group: poly-L-lysine, poly-L-ornithine, RGD peptide, fibronectin, vitronectin, collagen, and laminin.

Embodiment 138: The method of embodiment 126, wherein the synthetic RNA molecule contains at least one non-canonical nucleotide.

Embodiment 139: The method of embodiment 126, wherein the synthetic RNA molecule lacks any non-canonical nucleotides.

Embodiment 140: The method of embodiment 126, wherein the medium is substantially free of immunosuppressants.

Embodiment 141: A method for gene-editing a cell, comprising transfecting the cell with a complex of one or more synthetic RNA molecules and a compound, pharmaceutical composition, or lipid aggregate of any of the above embodiments, wherein the one or more synthetic RNA molecules include at least one RNA molecule encoding one or more gene-editing protein is selected from a nuclease, a transcription activator-like effector nuclease (TALEN), a zinc-finger nuclease, a meganuclease, a nickase, a clustered regularly interspaced short palindromic repeat (CRISPR)-associated protein, CRISPR/Cas9, Cas9, xCas9, Cas12a (Cpf1), Cas13a, Cas14, CasX, CasY, a Class 1 Cas protein, a Class 2 Cas protein, and MAD7, or a natural or engineered variant, family-member, orthologue, fragment or fusion construct thereof.

Embodiment 142: The method of embodiment 141, wherein the gene-editing protein comprises a DNA-binding domain comprising a plurality of repeat sequences and at least one of the repeat sequences comprises the amino acid sequence: LTPvQWAIAwxyzGHGG (SEQ ID NO: 629), wherein: "v" is Q, D or E, "w" is S or N, "x" is H, N, or I, "y" is D, A, I, N, G, H, K, S, or null, and "z" is GGKQALETVQRLLPVLCQD (SEQ ID NO: 630) or GGKQALETVQRLLPVLCQA (SEQ ID NO: 631).

Embodiment 143: The method of embodiment 141 or 142, wherein the gene-editing protein is between 36 and 39 amino acids long.

Embodiment 144: The method of any one of embodiments 141-143, wherein the gene-editing protein comprises a nuclease domain comprising a catalytic domain of a nuclease.

Embodiment 145: The method of any one of embodiments 141-144, wherein the nuclease is selected from StsI and FokI.

Embodiment 146: A method for extracting an organic compound from a reaction containing lithium aluminum hydride and a solvent comprising: (a) quenching the reaction with water; (b) removing the solvent; (c) removing excess water; and (d) extracting the organic compound with an alcohol; to yield an extracted organic compound.

Embodiment 147: The method of embodiment 146, wherein the alcohol is isopropyl alcohol.

Embodiment 148: A method for extracting an organic compound from a reaction containing a water-reactive compound and a first solvent comprising: (a) quenching the reaction with water; (b) removing the first solvent; (c) removing excess water; and (d) extracting the organic compound with a second solvent; to yield an extracted organic compound.

Embodiment 149: A method for purifying an organic compound from a mixture of the organic compound and a phthalimide or phthalimide derivative comprising: (a) dissolving the mixture in acetone to form a precipitate; (b) removing the precipitate by centrifugation; and (c) removing the acetone; to yield a purified organic compound.

Embodiment 150: The method of embodiment 149, wherein the phthalimide or phthalimide derivative is phthalhydrazine.

EXAMPLES

Example 1: Synthesis of Linoleoyl Chloride (1)

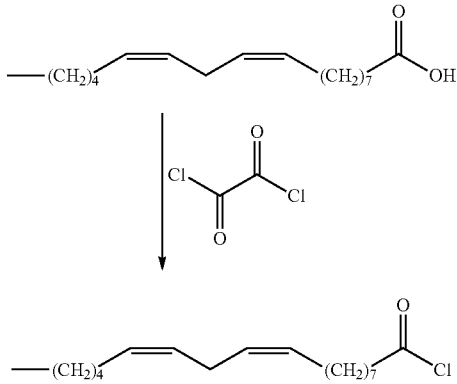

Oxalyl chloride (47.0 mL, 555 mmol) was added to a solution of linoleic acid (70.0 g, 250 mmol) in 580 mL anhydrous methylene chloride at 0° C. under N2 atmosphere. The reaction was warmed to room temperature and stirred vigorously for 24 hours. Solvent and oxalyl chloride were removed under reduced pressure to yield linoleoyl chloride as a brown oil, which was used without further purification.

Example 2: Synthesis of α-Linolenoyl Chloride (2)

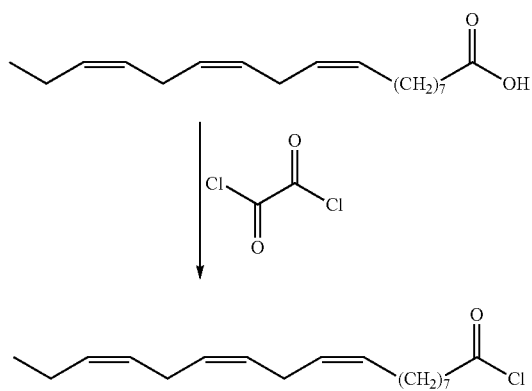

Oxalyl chloride (3.36 mL, 50.4 mmol) was added to α-linolenic acid (5.00 g, 18.0 mmol) in 35 mL anhydrous methylene chloride according to the protocol of Example 1. After 24 hours, solvent and oxalyl chloride were removed to yield 4.1 g of α-linolenoyl chloride as a yellow-brown oil.

Example 3: Synthesis of $N^1,N^4$-dilinoleoyl-di-aminobutane (3)

A solution of 1,4-diaminobutane (0.428 g, 4.86 mmol) and triethylamine (2.03 mL, 14.6 mmol) in 1 mL of anhydrous methylene chloride was slowly added to a solution of linoleoyl chloride (2.98 g, 10.0 mmol) in 30 mL of anhydrous methylene chloride in an ice bath at 0° C. The reaction mixture was stirred vigorously with a magnetic stir bar. After addition was complete, the ice bath was removed and the mixture was stirred at room temperature for 2.5 days. The reaction was cooled to 4° C., and a white solid precipitated from the solution. The excess linoleoyl chloride was removed by vacuum filtration. The precipitate was washed twice with 10 mL of methylene chloride. The mother liquor was concentrated and more product precipitated. This precipitate was filtered and combined with the previous precipitate. The resulting solid was vacuum dried for 4 hours. A total of 1.9 g of a white solid of the desired product, $N^1,N^4$-dilinoleoyl-diaminobutane, was obtained.

Example 4: Synthesis of $N^1,N^4$-dilinoleyl-di-aminobutane (4)

Lithium aluminum hydride (0.6 g, 95%, 16 mmol) was carefully added to a suspension of $N^1,N^4$-dilinoleoyl-di-aminobutane (1.8 g, 2.9 mmol) in 50 mL anhydrous diethyl ether at 0° C. After addition was complete, the ice bath was removed. The reaction mixture was warmed slowly to room temperature and then heated gently to reflux with an appropriate condensing device and stirred for 12 hours. The reaction mixture was cooled and quenched carefully at 0° C. with 5 mL of water. The diethyl ether was removed under reduced pressure, and the reaction mixture was dried under vacuum. The dried reaction mixture was extracted three times with 25 mL of isopropyl alcohol at 80° C. The isopropyl alcohol was removed to yield 1.6 g of oily colorless $N^1,N^4$-dilinoleyl-diaminobutane.

Example 5: Synthesis of $N^1,N^4$-dilinoleyl-$N^1,N^4$-di-[2-hydroxy-3-(N-phthalamido)propyl]-diaminobutane (5)

Diisopropylethylamine (1.15 mL, 12.0 mmol) was added to a suspension of $N^1,N^4$-dilinoleyl-diaminobutane (1.6 g, 2.7 mmol) and N-(2,3-epoxypropyl)-phthalimide (1.6 g, 7.9 mmol) in 12 mL of dry N,N-dimethylformamide. After purging with nitrogen, the reaction mixture was sealed in a round-bottom flask and heated to around 90° C. for 24 hours. N,N-dimethylformamide and diisopropylethylamine were removed and a yellow oil was obtained. Synthesis was continued without additional purification.

Example 6: Synthesis of $N^1,N^4$-dilinoleyl-$N^1,N^4$-di-(2-hydroxy-3-aminopropyl)-diaminobutane (6)

The entire crude oil of $N^1,N^4$-dilinoleyl-$N^1,N^4$-di-[2-hydroxy-3-(N-phthalamido)propyl]-diaminobutane was dissolved in 25 mL of anhydrous ethanol. Hydrazine (0.5 mL, 64-65% aq., 10.3 mmol) was added at room temperature. With an appropriate condensing device, the reaction mixture was heated to reflux. The oil bath was set to 85° C. After 15 minutes, a white solid precipitated from the solution. The reaction mixture was stirred at reflux for 4 hours before being cooled to –20° C. The white solid was removed by gravity filtration. The residue was washed twice with cold ethanol. The combined ethanol solution was concentrated and dried overnight under vacuum. The crude product was extracted with acetone. The combined acetone solution was concentrated and dried overnight under vacuum. 1.0 g of an oil, $N^1,N^4$-dilinoleyl-$N^1,N^4$-di-(2-hydroxy-3-aminopropyl)-diaminobutane (hereinafter referred to as DHDLinS or DLinDHS), was obtained. A process of a synthesis of DLinDHS is shown schematically in FIG. 12.

Example 7 Synthesis of Lipids

The following compounds are synthesized by the methods of Examples 1 through 6 using the corresponding amine and acyl chloride:
$N^1,N^4$-dilinolenoyl-$N^1,N^4$-di-(2-hydroxy-3-aminopropyl)-diaminobutane (7);
$N^1,N^2$-dilinoleyl-$N^1,N^2$-di-(2-hydroxy-3-aminopropyl)-diaminoethane (8);
$N^1,N^3$-dilinoleyl-$N^1,N^3$-di-(2-hydroxy-3-aminopropyl)-diaminopropane (9);
$N^1,N^5$-dilinoleyl-$N^1,N^5$-di-(2-hydroxy-3-aminopropyl)-diaminopentane (10);
$N^1,N^6$-dilinoleyl-$N^1,N^6$-di-(2-hydroxy-3-aminopropyl)-diaminohexane (11);
Linoleyl-bis(N-linoleyl-N-(2-hydroxy-3-aminopropyl)-2-aminoethyl)amine (12);
$N^1,N^3$-dilinoleyl-$N^1$—(N-linoleyl-N-[2-hydroxy-3-aminopropyl]-2-aminoethyl)-$N^3$-[2-hydroxy-3-aminopropyl]-1,3-diaminopropane (13);
Linoleyl-bis(N-linoleyl-N-(2-hydroxy-3-aminopropyl)-2-aminopropyl)amine (14);
$N^1,N^4$-dilinoleyl-$N^1$—(N-linoleyl-N-[2-hydroxy-3-aminopropyl]-3-aminopropyl)-$N^4$-[2-hydroxy-3-aminopropyl]-1,4-diaminobutane (15);
$N^1,N^4$-bis(N-linoleyl-N-[2-hydroxy-3-aminopropyl]-aminopropyl)-1,4-diaminobutane (16).

Example 8: Transfection with Inventive Lipids

Stock solutions of lipid in ethanol were prepared at 20 mg/mL and at 5 mg/mL and stored at −20° C. To perform transfections, nucleic acid was first diluted in DMEM (1 µg of nucleic acid in 50 µL of DMEM), then the desired amount of lipid stock solution was added. After adding the lipid, the solution was mixed thoroughly, and complexes were allowed to form for between about 5 minutes and 25 minutes before adding to cells. For the experiments depicted in FIG. 1 through FIG. 6, the lipid was used without the acetone purification described in Example 6.

FIG. 1 depicts transfection of primary human epidermal keratinocytes with in vitro transcribed RNA encoding green fluorescent protein (GFP) complexed with the various lipids. As shown in the figure, cells were transfected with high efficiency by DHDLinS.

Figure 2:
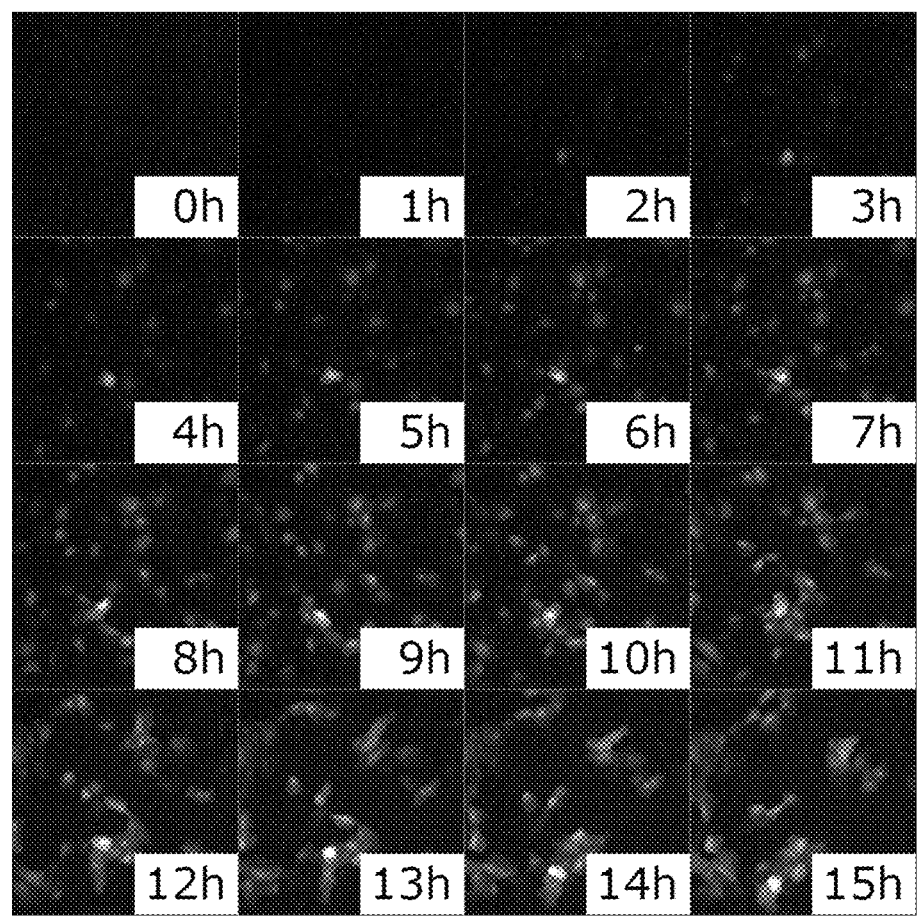

FIG. 2 depicts a time course of the experiment of FIG. 1, i.e. florescence measured at the indicated time points following transfection using DHDLinS. A fluorescent signal was detected one hour following transfection, and both the signal intensity and number of fluorescent cells increased for several hours following transfection.

Figure 3:
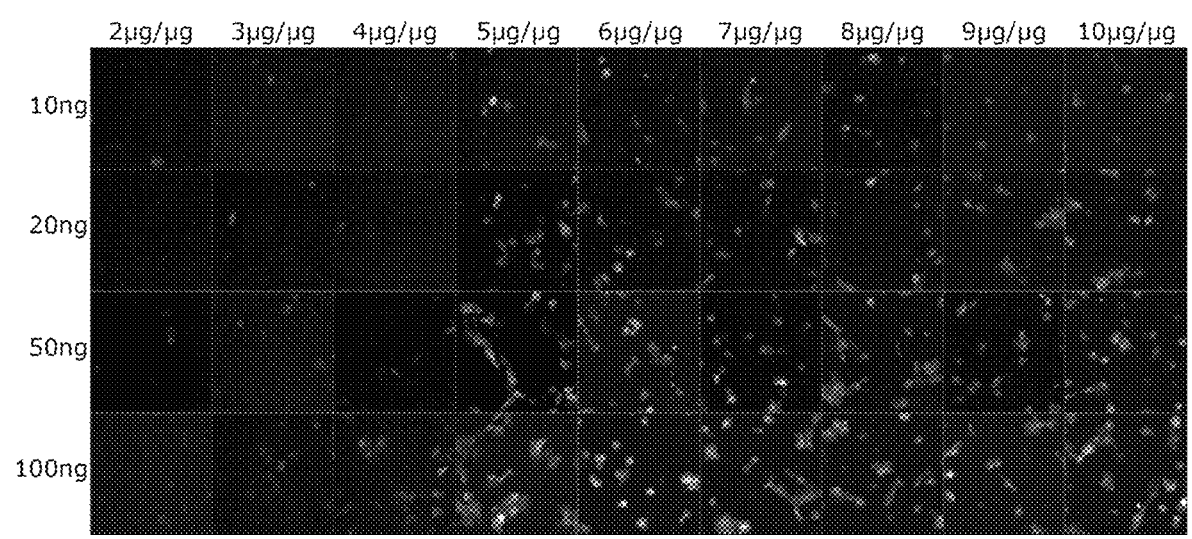

FIG. 3 depicts transfection with various indicated amounts of RNA (in nanograms) and lipid-to-RNA mass ratios (in micrograms of lipid per microgram of RNA). As shown in the figure, all RNA amounts and lipid-to-RNA mass ratios tested yielded a fluorescent signal. In general, larger amounts of RNA yielded a stronger signal and/or larger number of fluorescent cells, while minimal increase in fluorescence signal was observed at lipid-to-RNA mass ratios greater than 5 µg/µg.

Figure 4:
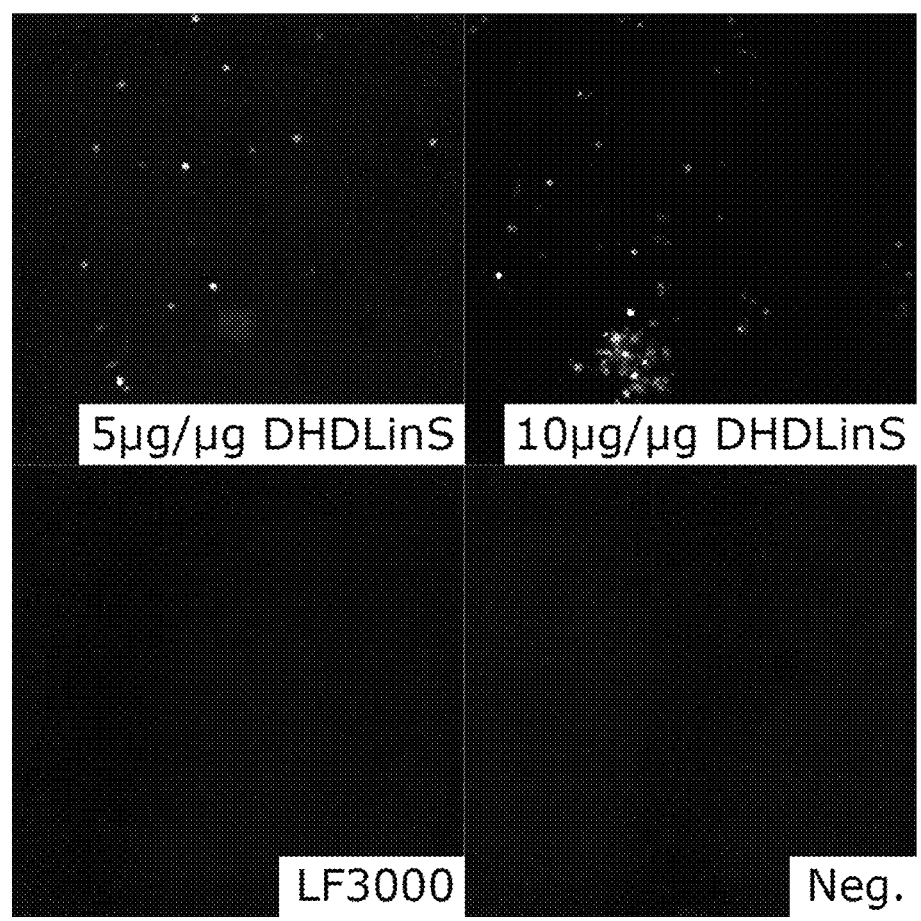
FIG. 4 depicts the results of an experiment conducted as in FIG. 1, but with human peripheral blood mononuclear cells (hPBMCs) instead of keratinocytes. Images were taken 16 hours following transfection. "LF3000" indicates cells transfected with LIPOFECTAMINE 3000 commercial transfection reagent. "Neg." indicates un-transfected cells as compared to cells transfected with DHDLinS.

FIG. 4 depicts a transfection experiment with human peripheral blood mononuclear cells (hPBMCs) instead of keratinocytes. As shown in the figure, DHDLinS effectively transfected hPBMCs at both lipid-to-RNA mass ratios tested, while no transfection was observed with LIPOFECTAMINE 3000, ("LF3000") a commercial transfection reagent.

Figure 5A:
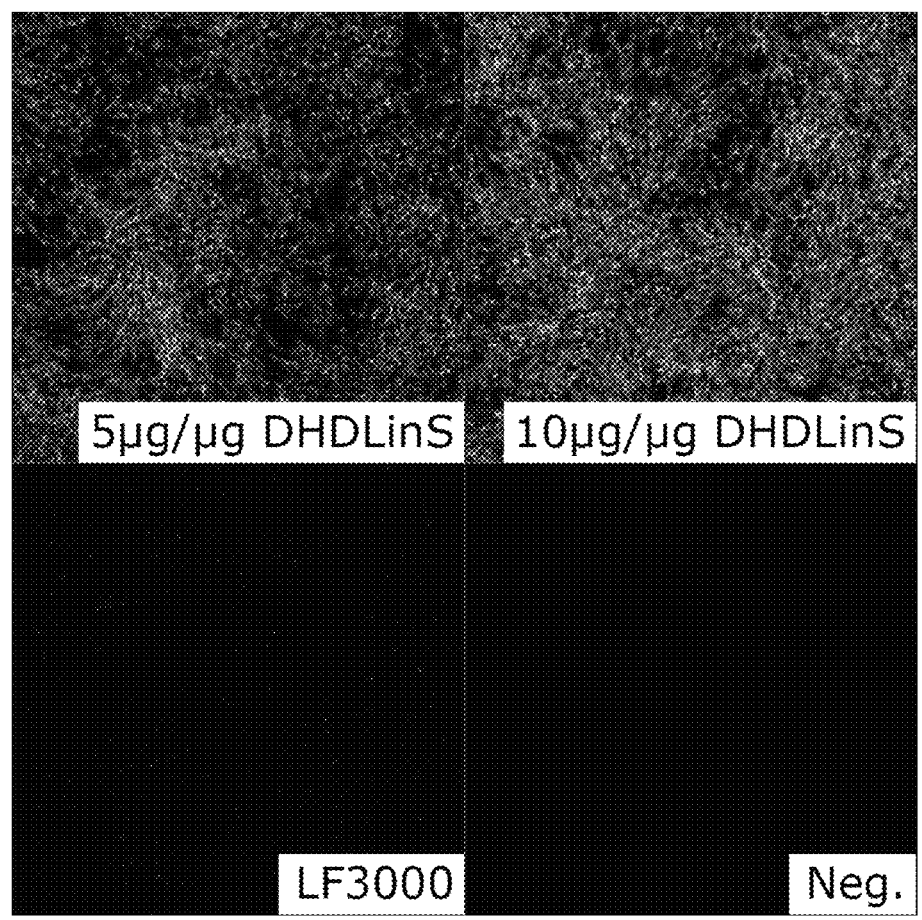
FIG. 5A depicts the results of an experiment conducted as in FIG. 4, but with a confluent layer of primary human epidermal keratinocytes instead of hPBMCs. Images were taken 24 hours following transfection.
Figure 5B:
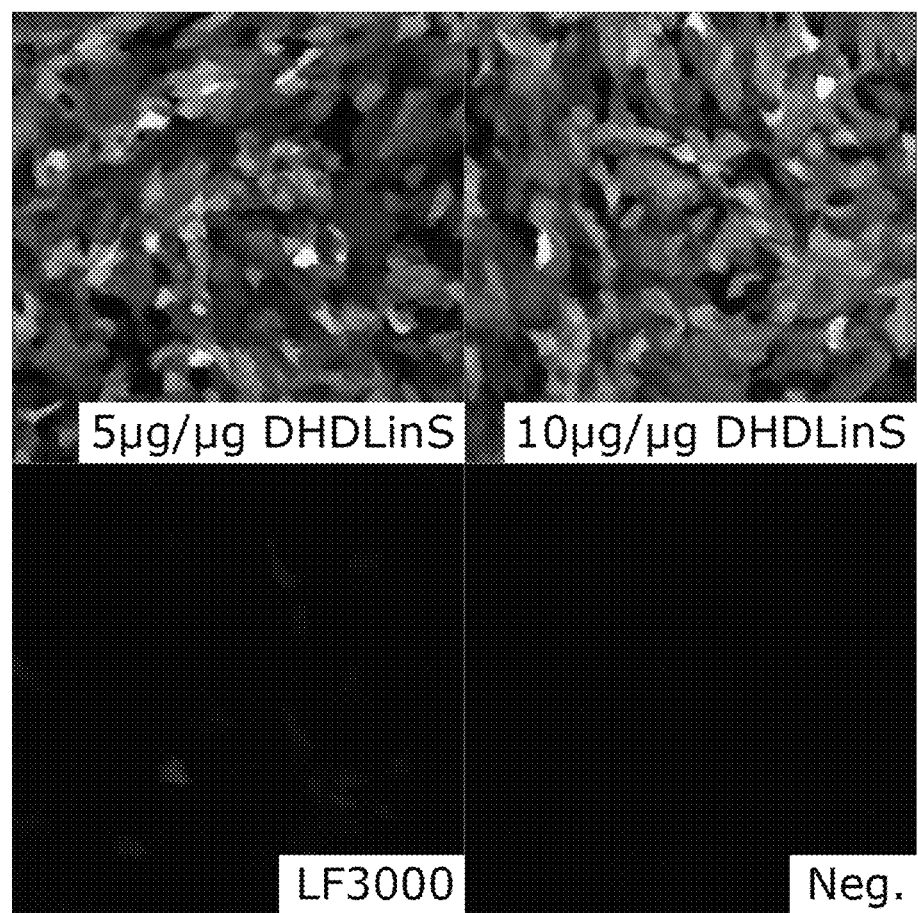
FIG. 5B depicts the experiment of FIG. 5A, shown at higher magnification.

FIG. 5A extends the transfection findings to a confluent layer of primary human epidermal keratinocytes instead of hPBMCs. As shown in the figure, DHDLinS effectively transfected confluent primary human epidermal keratinocytes at both lipid-to-RNA mass ratios tested, while the cells treated with LIPOFECTAMINE 3000 were not efficiently transfected. FIG. 5B depicts this at higher magnification. As shown in the figure, DHDLinS effectively transfected confluent primary human epidermal keratinocytes at both lipid-to-RNA mass ratios tested, while the cells treated with LIPOFECTAMINE 3000 were not efficiently transfected.

Figure 6:
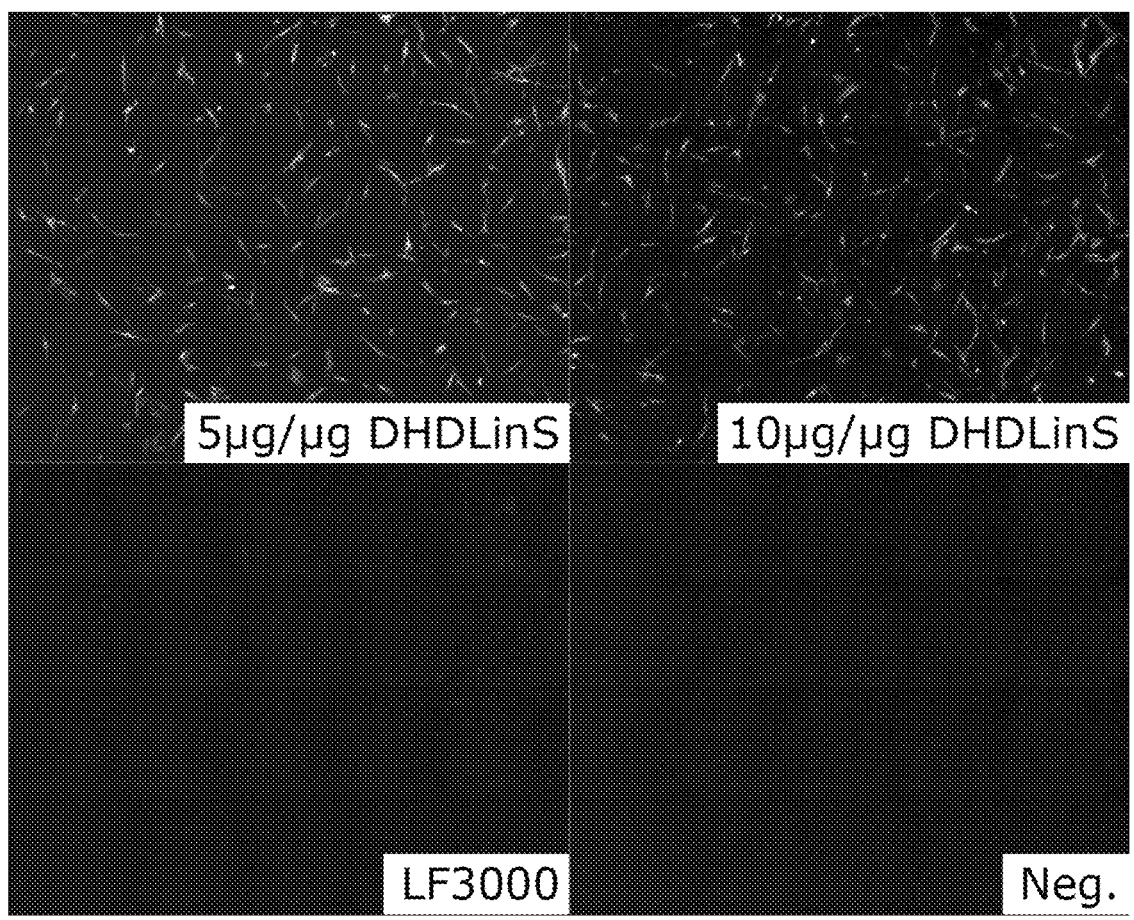
FIG. 6 depicts the results of an experiment conducted as in FIG. 4, but with primary human adult dermal fibroblasts instead of hPBMCs. Images were taken 16 hours following transfection.
Figure 7:
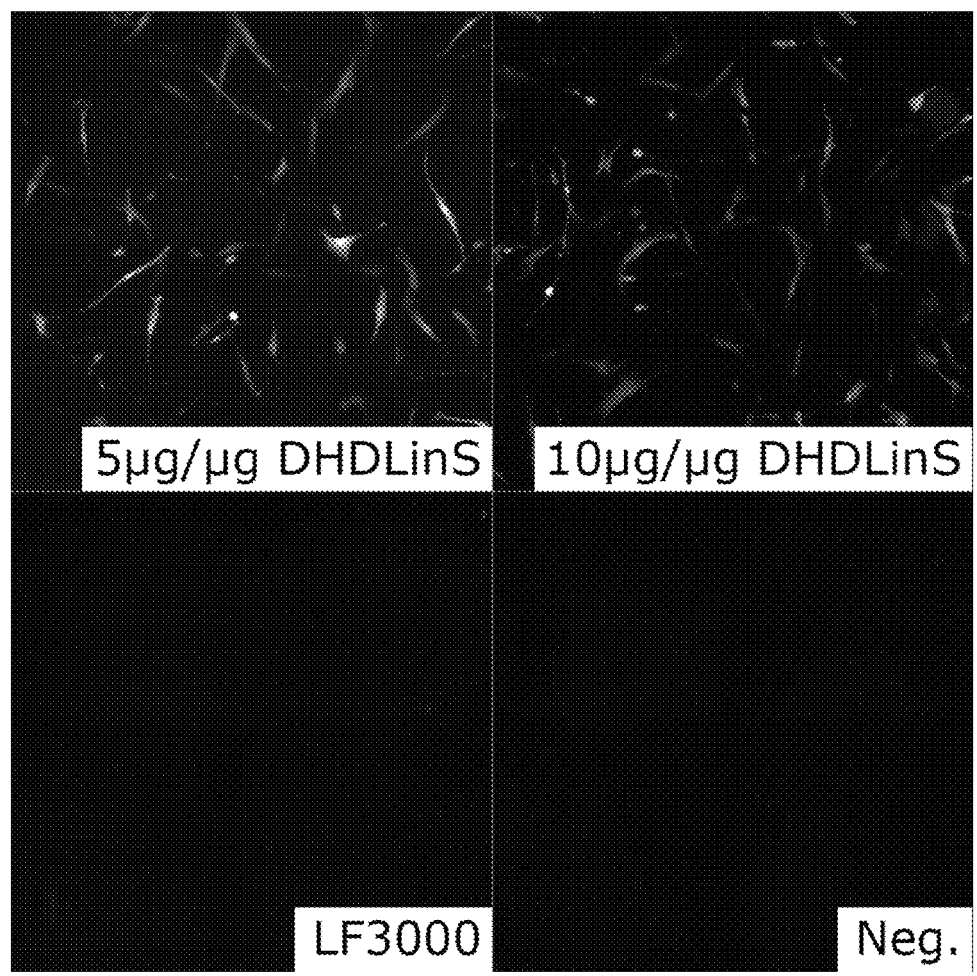
FIG. 7 depicts the experiment of FIG. 6, shown at higher magnification.

FIG. 6 depicts the results of an experiment conducted as in FIG. 4, but with primary human adult dermal fibroblasts instead of hPBMCs. As shown in the figure, DHDLinS effectively transfected primary human adult dermal fibroblasts at both lipid-to-RNA mass ratios tested, while the cells treated with LIPOFECTAMINE 3000 were not efficiently transfected. FIG. 7 depicts this experiment at higher magnification. As shown in the figure, DHDLinS effectively transfected primary human adult dermal fibroblasts at both lipid-to-RNA mass ratios tested, while the cells treated with LIPOFECTAMINE 3000 were not efficiently transfected.

Figure 8:
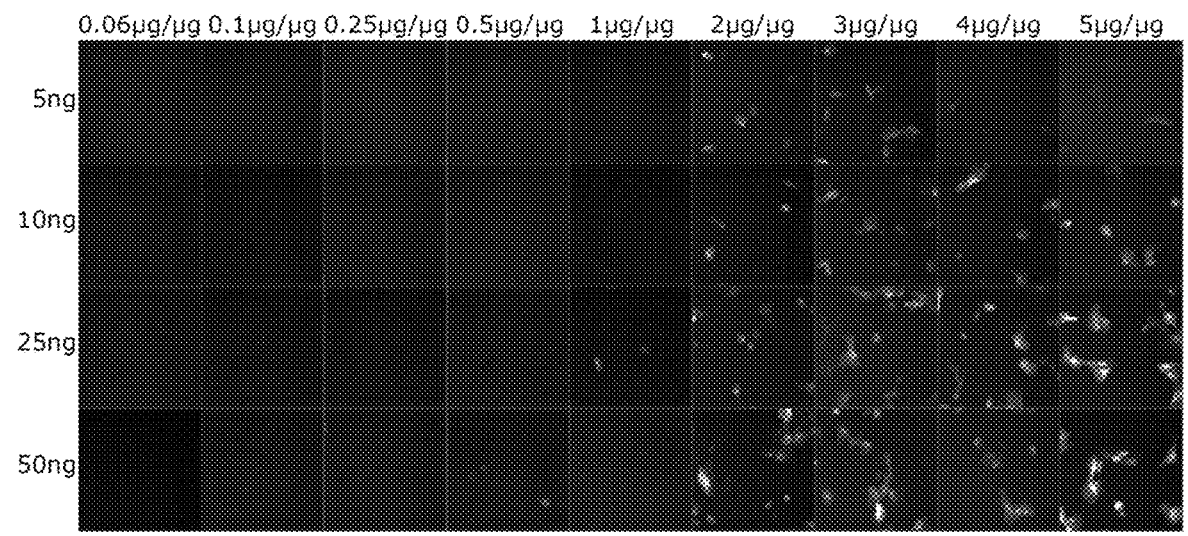
FIG. 8 depicts the results of an experiment conducted as in FIG. 3, but with DHDLinS purified by extraction with acetone as described in Example 6.

FIG. 8 depicts the results of an experiment conducted as in FIG. 3, but with DHDLinS purified by extraction with acetone as described in Example 6. As shown in the figure, minimal increase in fluorescence signal was observed at lipid-to-RNA mass ratios greater than 2 µg/µg.

Figure 9:
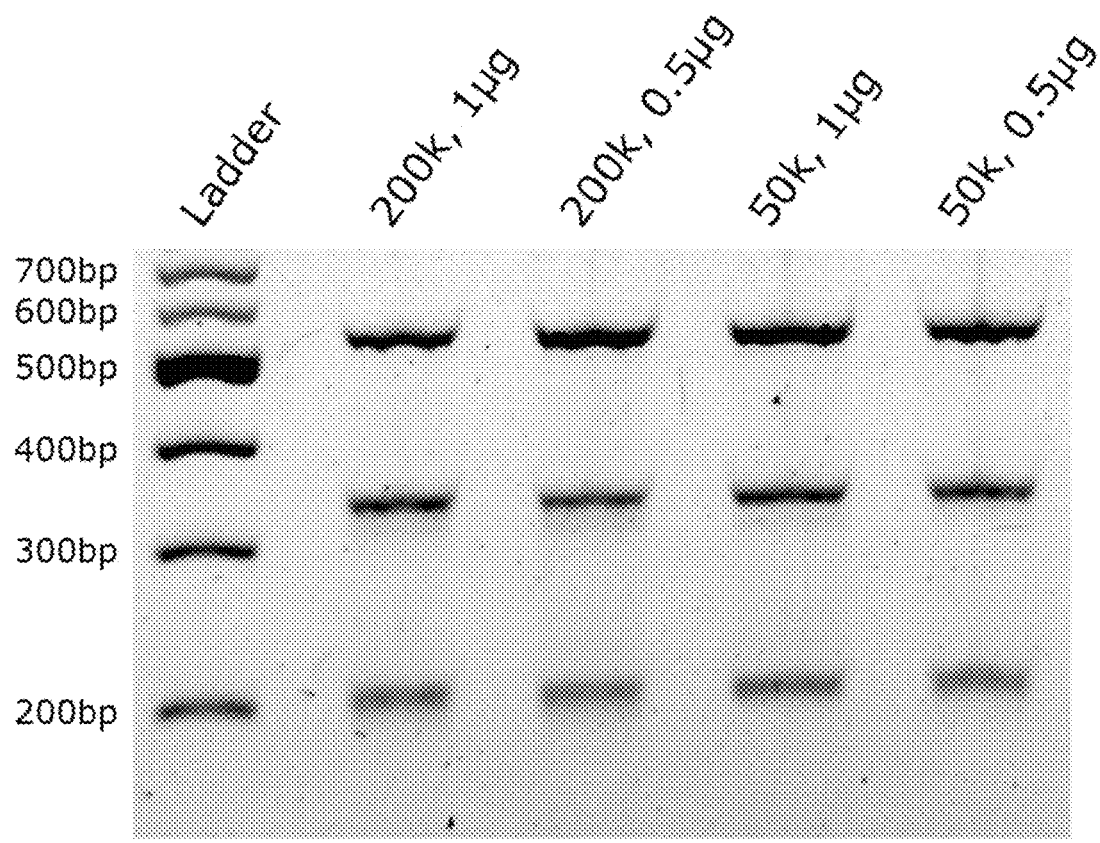
FIG. 9 depicts the results of an experiment in which primary human epidermal keratinocytes were transfected with in vitro transcribed RNA encoding gene-editing proteins complexed with DHDLinS.

FIG. 9 depicts the results of an experiment in which primary human epidermal keratinocytes were transfected with in vitro transcribed RNA encoding gene-editing proteins complexed with DHDLinS. Gene-editing efficiency was measured by hybridizing an amplicon containing the target sequence and generated from genomic DNA of transfected cells with an identically prepared amplicon generated from untreated cells, followed by digestion with T7E1 endonuclease. As shown in the figure, cells were gene edited at high efficiency. The numbers above each lane indicate the number of cells transfected, and the amount of RNA transfected.

FIG. 10 depicts the results of an experiment in which primary human epidermal keratinocytes were transfected with in vitro transcribed RNA encoding GFP complexed with DLinDHS at a lipid-to-RNA mass ratios of 2.5 µg/µg as described in Example 8. The mRNA-DLinDHS complexes were added to 20,000 human epidermal keratinocytes in serum-free medium (0% FBS) or 50% FBS. Images were taken 16 hours following transfection. The results of the measured florescence are shown in the right panel, which illustrate that DLinDHS efficiently delivers mRNA in 50% serum. The left panel illustrates, for comparison, that serum inhibits mRNA delivery using LNPs. In particular, GFP-encoding mRNA was formulated into LNPs composed of DLin-MC3-DMA, DOPE, cholesterol, DMPE-PEG (molar ratio 30:30:38.5:1.5). The mRNA-LNPs (300 ng final mRNA) were added to 20,000 human epidermal keratinocytes in serum-free medium (0% FBS) or 50% FBS. Images were taken 16 hours following transfection.

FIG. 11A illustrates the results of an experiment in which primary human dermal fibroblasts were transfected with in vitro transcribed RNA encoding GFP and complexed with DLinDHS at a lipid-to-RNA mass ratios of 2.5 µg/µg as described in Example 8. 100 ng of GFP-encoding mRNA, 20% of which was labeled with Cy5, was added to 20,000 human dermal fibroblasts in 10% FBS. Fluorescence images were taken at 10-minute intervals for 10 hours following transfection, with Cy5-labeled RNA and GFP resolved in separate channels. The images in FIG. 11A show that mRNA was detected in cytoplasm within 50 minutes of contact with DLinDHS lipoplexes, and that protein expression begins within 2.5 hours after transfection.

FIG. 11B illustrates the results of an experiment in which primary human dermal fibroblasts were transfected with in vitro transcribed RNA encoding GFP and complexed with labeled DLinDHS. DLinDHS was conjugated with BODIPY-NHS ester fluorophore (Molecular Probes, Eugene, OR) at a 10:1 molar ratio of DLinDHS to fluorophore, and complexed with RNA as described in Example 8. 200 ng of GFP-encoding mRNA was added to cells. Fluorescence images were taken at 20-minute intervals for 4 hours following transfection, including immediately after administration of complexes ("0 min"), with BODIPY-labeled DLinDHS and GFP resolved in separate channels. The images in FIG. 11B show that DLinDHS contacts cells within minutes after transfection, and that most cells are contacted by multiple lipoplexes.

Example 9: Investigation of the Effect of Headgroup Size and Degree of Unsaturation in the Fatty-Acid Tail of DLinDHS A study was conducted to, in part, assess the effect of a size of the dihydroxyspermine (DHS) headgroup of DLinDHS, and a degree of unsaturation in the fatty-acid tail of DLinDHS.

FIG. 13 illustrates the results of an experiment in which primary human epidermal keratinocytes were transfected with in vitro transcribed RNA encoding GFP and complexed with compounds of the invention, comprising a dihydroxyspermine headgroup conjugated to different fatty-acid derived tails, including myristyl, oleyl, linoleyl, and linolenyl. In this experiment, 100 ng GFP-encoding RNA, complexed with the above lipids and with LIPOFECTAMINE 2000 (as a control), was added to 20,000 keratinocytes in 50% FBS. The results are shown in the graph of FIG. 13, as fluorescence (a.u.) versus the time after transfection (hours).

FIG. 14 illustrates the results of an experiment in which primary human epidermal keratinocytes were transfected with in vitro transcribed RNA encoding GFP and complexed with compounds of the invention, comprising a dilinoleyl fatty-acid derived tail structure. The tested compounds' structure is a bis-(2-hydroxy-3-aminopropyl)-N,N'-dilinoleyl-diamine, as shown in the figure, with the labels indicating the length of the central inter-amino carbon chain of the headgroup (C2, C4, C5, C6, C8, C10, and C12). LIPOFECTAMINE 2000 was used as a control. In this experiment, 100 ng GFP-encoding mRNA, complexed with lipids of the invention or with LIPOFECTAMINE 2000, was added to 20,000 keratinocytes in 50% FBS. The results are illustrated in the graph of FIG. 14, showing fluorescence (a.u.) versus the time after transfection (hours).

Example 10: Investigation of the Ability of DLinDHS/mRNA Lipoplexes to Exhibit Ionic Strength-Dependent Particle Size and pH-Dependent Zeta Potential FIG. 15 illustrates that the particle size of DLinDHS lipoplex is ionic-strength dependent. DLinDHS/RNA complexes were formed by dilution of lipid from ethanol stock into aqueous mRNA solution with varied concentration of sodium chloride. The particle size was measured by dynamic light scattering (DLS). The graph in FIG. 15 illustrates Z-average particle size (nm) and polydispersity index (PDI) of DLinDHS/RNA complexes, formed in nine different complexation media.

FIG. 16 illustrates that DLinDHS lipoplexes have pH-dependent zeta potential. In vitro transcribed RNA encoding GFP was complexed with DLinDHS at a lipid-to-RNA mass ratio of 2.5 µg/µg as described in Example 8, then diluted into a 20 mM citrate, pH 3.0-6.0, or 20 mM phosphate, pH 7.4). The graph depicts zeta potential (mV) as a function of dilution buffer pH. In this study, −22.1 mV zeta potential at pH 7.4 implies stable dispersion.

Example 11: Investigation of Ability of DLinDHS to Protect mRNA from RNase a Degradation This study was conducted to assess whether DLinDHS protects mRNA from RNase A degradation. Primary human epidermal keratinocytes were transfected with in vitro transcribed RNA encoding GFP and complexed with DLinDHS at a lipid-to-RNA mass ratio of 2.5 µg/µg as described in Example 8. For the experiment, the GFP-encoding mRNA was incubated with RNase A either before or after complexation with DLinDHS. Complexes were added to 20,000 keratinocytes in serum-free medium. FIG. 17 depicts fluorescence microscopy images of cells transfected with DLinDHS/RNA complexes without treatment with RNase A ("No treatment"), DLinDHS/RNA complexes treated with RNase A after complexation ("RNase after complexation"), and DLinDHS complexed with RNA treated with RNase A prior to complexation ("RNase before complexation"). As shown, for the DLinDHS/mRNA complexes treated with RNase after complexation, the RNA was protected from degradation such that the GFP expression was similar to GFP expression of the DLinDHS/mRNA complex not treated with RNase.

Example 12: Investigation of mRNA Delivery to Various Types of Cells

This study was conducted to assess the efficiency of delivery of mRNA complexed with DLinDHS in various cell types using a reporter protein. Primary human dermal fibroblasts, activated human peripheral blood monocytes (PBMCs), human lung adenocarcinoma cells, induced pluripotent stem cells (iPS cells), and rat embryonic cortical neurons were transfected with in vitro transcribed RNA encoding GFP and complexed with DLinDHS at a lipid-to-RNA mass ratio of 2.5 µg/µg as described in Example 8. FIG. 18 depicts (the top panels, "GFP") the results of the five types of cells transfected with in vitro transcribed GFP-encoding RNA that is complexed with DLinDHS lipoplex. The bottom panels ("Neg.") of FIG. 18 depict negative control experiments wherein no RNA was delivered.

Example 13: Investigation of mRNA Delivery to Multiple Tissues in Rat

A study was conducted to, in part, assess the uptake of mRNA complexed with the lipids of the present invention following delivery by multiple routes in rat. In vitro transcribed RNA encoding GFP and complexed with DLinDHS at a lipid-to-RNA mass ratio of 2.5 µg/µg as described in Example 8 is administered to rats according to the study parameters:

| Test System | | | | | |
|---|---|---|---|---|---|
| Species | Strain | Number | Gender | Wt. Range | No. of Spares (purchased) |
| Rat | Sprague Dawley | 22 | Either | 170-200 g | 0 |

| Study Design Table | | | | | |
|---|---|---|---|---|---|
| Group | No. of Animals | Description of Treatment | No. of Treatments per animal | Interim Procedures | Necropsy Time point |
| 1 | 2 | Intradermal injection (mRNA) | 1 | None | 48 hours |
| 2 | 2 | Liver infusion (mRNA) | 1 | None | 48 hours |
| 3 | 2 | Neostriatal injection (mRNA) | 1 | None | 48 hours |
| 4 | 2 | Lateral ventricle injection (mRNA) | 1 | None | 48 hours |

Study Design Table

| Group | No. of Animals | Description of Treatment | No. of Treatments per animal | Interim Procedures | Necropsy Time point |
|---|---|---|---|---|---|
| 5 | 2 | Unilateral Intravitreal injection (mRNA) | 1 | None | 48 hours |
| 6 | 4 | Unilateral Subretinal injection (mRNA) | 1 | None | 48 hours |
| 7 | 2 | Unilateral Topical ophthalmic application (mRNA) | 1 | None | 48 hours |
| 8 | 2 | Tail vein injection (Saline) | 1 | None | 48 hours |
| 9 | 2 | Tail vein injection (mRNA-A) | 1 | None | 48 hours |
| 10 | 2 | Tail vein injection (mRNA-B) | 1 | None | 48 hours |

Histology Processing

| Tissue | Embedding | Total No. of Blocks | No. of Slides per Block | Stain | Total Slides |
|---|---|---|---|---|---|
| Skin (Group 1) | Paraffin | 2 | 5 | None | 10 |
| Liver (Group 2, 8-10) | Paraffin | 8 | 5 | None | 40 |
| Brain (Groups 3-4, 8-10) | Paraffin | 10 | 15 | None | 150 |
| Eye (injected) (Groups 5-7) | Paraffin | 8 | 20 | None | 160 |
| Heart (Groups 8-10) | Paraffin | 6 | 5 | None | 30 |
| Lungs (Groups 8-10) | Paraffin | 12 | 5 | None | 60 |
| Kidneys (Groups 8-10) | Paraffin | 12 | 5 | None | 60 |
| Spleen (Groups 8-10) | Paraffin | 6 | 5 | None | 30 |
| Total Slides | | | | | 540 |

Notes:

Eyes (injected eye only) will be embedded with paraffin and microtome sectioned.

Blocks will be faced off and 2 consecutive slides collected (2-5 micron sections per slide).

The blocks will be advanced in 0.5 mm increments 10x, producing 20 slides per block.

Sections to be mounted on slides and delivered to sponsor for staining.

Brain sections will include 5 slides each from forebrain, mid-brain, and hind-brain/cerebellum.

Collected slides were stained with hematoxylin and with a rabbit anti-GFP antibody to determine the localization and extent of reporter protein expression in the collected tissues of interest.

FIG. 19 shows (left panel) the image of the rat tissue at 80 μm scale, and (right panel) the image of the rat tissue at 20 μm scale. As shown in FIG. 19, intradermal injection of DLinDHS complexed with mRNA encoding the reporter protein (GFP) yielded localized expression in the dermal layer.

Example 14: Investigation of In Vivo mRNA Delivery to a Human Subject by Intradermal Injection This study was conducted to assess the uptake of mRNA complexed with the lipids of the present invention following intradermal injection to a human subject. In vitro transcribed RNA encoding red fluorescent protein (RFP) complexed with DLinDHS at a lipid-to-RNA mass ratio of 2.5 μg/μg as described in Example 8 was administered to a ventral forearm of a human male via intradermal injection (400 ng of RNA in a total volume of 20 μL). After 48 hours, skin from the injection site was biopsied and imaged by confocal fluorescence microscopy. FIG. 20A shows (top panel) images of skin into which DLinDHS/mRNA complexes were injected and (bottom panel) a negative control. FIG. 20B shows magnified images on which the arrows indicate RFP-positive cells that have a morphology consistent with that of fibroblasts.

EQUIVALENTS

Those skilled in the art will recognize, or be able to ascertain, using no more than routine experimentation, numerous equivalents to the specific embodiments described specifically herein. Such equivalents are intended to be encompassed in the scope of the following claims.

INCORPORATION BY REFERENCE

All patents and publications referenced herein are hereby incorporated by reference in their entireties.

SEQUENCE LISTING (862 sequences)

SEQ ID NO: 1 - protein, 195 aa, Homo sapiens
VLEKSDIEKFKNQLRTELTNIDHSYLKGIDIASKKKTSNVENTEFEAISTKIFTDELGFSGKHLGGSNKPDGLLWDDDCAIILDSKAYSEGFPLTASHTDAMGRYLRQFTERKEEIKPTWWDIAPEHLDNTYFAYVSGSFSGNYKEQLQKFRQDTNHLGGALEFVKLLLLANNYKTQKMSKKEVKKSILDYNISY

SEQ ID NO: 2 - protein, 195 aa, Homo sapiens
VLEKSDIEKFKNQLRTELTNIDHSYLKGIDIASKKKTSNVENTEFEAISTKIFTDELGFSGEHLGGSNKPDGLLWDDDCAIILDSKAYSEGFPLTASHTDAMGRYLRQFTERKEEIKPTWWDIAPEHLDNTYFAYVSGSFSGNYKEQLQKFRQDTNHLGGALEFVKLLLLANNYKTQKMSKKEVKKSILDYNISY

SEQ ID NO: 3 - protein, 195 aa, Homo sapiens
VLEKSDIEKFKNQLRTELTNIDHSYLKGIDIASKPKTSNVENTEFEAISTKIFTDELGFSGKHLGGSNKPDGLLWDDDCAIILDSKAYSEGFPLTASHTDAMGRYLRQFTERKEEIKPTWWDIAPEHLDNTYFAYVSGSFSGNYKEQLQKFRQDTNHLGGALEFVKLLLLANNYKTQKMSKKEVKKSILDYNISY

SEQ ID NO: 4 - protein, 195 aa, Homo sapiens
VLEKSDIEKFKNQLRTELTNIDHSYLKGIDIASKPKTSNVENTEFEAISTKIFTDELGFSGEHLGGSNKPDGLLWDDDCAIILDSKAYSEGFPLTASHTDAMGRYLRQFTERKEEIKPTWWDIAPEHLDNTYFAYVSGSFSGNYKEQLQKFRQDTNHLGGALEFVKLLLLANNYKTQKMSKKEVKKSILDYNISY

SEQ ID NO: 5 - protein, 191 aa, Homo sapiens
VLEKSDIEKFKNQLRTELTNIDHSYLKGIDIASKPVENTEFEAISTKIFTDELGFSGEHLGGSNKPDGLLWDDDCAIILDSKAYSEGFPLTASHTDAMGRYLRQFTERKEEIKPTWWDIAPEHLDNTYFAYVSGSFSGNYKEQLQKFRQDTNHLGGALEFVKLLLLANNYKTQKMSKKEVKKSILDYNISY

SEQ ID NO: 6 - protein, 195 aa, Homo sapiens
VLEKSDIEKFKNQLRTELTNIDHSYLKGIDIASKKKTSNVENTEFEAISTKIFTDELGFSGKHLGGSNKPDGLLWDDDCAIILDSKAYSEGFPLTASHTDAMGRYLRQFTERKEEIKPTWWDIAPEHLDNTYFAYVSGSFSGDYKEQLQKFRQDTNHLGGALEFVKLLLLANNYKTQKMSKKEVKKSILDYNISY

SEQ ID NO: 7 - protein, 195 aa, Homo sapiens
VLEKSDIEKFKNQLRTELTNIDHSYLKGIDIASKKKTSNVENTEFEAISTKIFTDELGFSGKHLGGSNKPDGLLWDDDCAIILDSKAYSEGFPLTASHTDAMGRYLRQFTERKEEIKPTWWDIAPEHLDNTYFAYVSGSFSGDYKEQLQKFRQNTNHLGGALEFVKLLLLANNYKTQKMSKKEVKKSILDYNISY

SEQ ID NO: 8 - protein, 360 aa, Homo sapiens
MAGHLASDFAFSPPPGGGGDGPGGPEPGWVDPRTWLSFQGPPGGPGIGPGVGPGSEVWGIPPCPPPYEFCGGMAYCGPQVGVGLVPQGGLETSQPEGEAGVGVESNSDGASPEPCTVTPGAVKLEKEKLEQNPEESQDIKALQKELEQFAKLLKQKRITLGYTQADVGLTLGVLFGKVFSQTTICRFEALQLSFKNMCKLRPLLQKWVEEADNNENLQEICKAETLVQARKRKRTSIENRVRGNLENLFLQCPKPTLQQISHIAQQLGLEKDVVRVWFCNRRQKGKRSSSDYAQREDFEAAGSPFSGGPVSFPLAPGPHFGTPGYGSPHFTALYSSVPFPEGEAFPPVSVTTLGSPMHSN

SEQ ID NO: 9 - protein, 317 aa, Homo sapiens
MYNMMETELKPPGPQQTSGGGGGNSTAAAAGGNQKNSPDRVKRPMNAFMVWSRGQRRKMAQENPKMHNSEISKRLGAEWKLLSETEKRPFIDEAKRLRALHMKEHPDYKYRPRRKTKTLMKKDKYTLPGGLLAPGGNSMASGVGVGAGLGAGVNQRMDSYAHMNGWSNGSYSMMQDQLGYPQHPGLNAHGAAQMQPMHRYDVSALQYNSMTSSQTYMNGSPTYSMSYSQQGTPGMALGSMGSVVKSEASSSPPVVTSSSHSRAPCQAGDLRDMISMYLPGAEVPEPAAPSRLHMSQHYQSGPVPGTAINGTLPLSHM

SEQ ID NO: 10 - protein, 479 aa, Homo sapiens
MRQPPGESDMAVSDALLPSFSTFASGPAGREKTLRQAGAPNNRWREELSHMKRLPPVLPGRPYDLAAATVATDLESGGAGAACGGSNLAPLPRRETEEFNDLLDLDFILSNSLTHPPESVAATVSSSASASSSSSPSSSGPASAPSTCSFTYPIRAGNDPGVAPGGTGGGLLYGRESAPPPTAPFNLADINDVSPSGGFVAELLRPELDPVYIPPQQPQPPGGGLMGKFVLKASLSAPGSEYGSPSVISVSKGSPDGSHPVVVAPYNGGPPRTCPKIKQEAVSSCTHLGAGPPLSNGHRPAAHDFPLGRQLPSRTTPTLGLEEVLSSRDCHPALPLPPGFHPHPGPNYPSFLPDQMQPQVPPLHYQELMPPGSCMPEEPKPKRGRRSWPRKRTATHTCDYAGCGKTYTKSSHLKAHLRTHTGEKPYHCDWDGCGWKFARSDELTRHYRKHTGHRPFQCQKCDRAFSRSDHLALHMKRHF

SEQ ID NO: 11 - protein, 454 aa, Homo sapiens
MDFFRVVENQQPPATMPLNVSFTNRNYDLDYDSVQPYFYCDEEENFYQQQQQSELQPPAPSEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSVCSTSSLYLQDLSAAASECIDPSVVFPYPLNDSSSPKSCASQDSSAFSPSSDSLLSSTESSPQGSPEPLVLHEETPPTTSSDSEEEQEDEEEIDVVSVEKRQAPGKRSESGSPSAGGHSKPPHSPLVLKRCHVSTHQHNYAAPPSTRKDYPAAKRVKLDSVRVLRQISNNRKCTSPRSSDTEENVKRRTHNVLERQRRNELKRSFFALRDQIPELENNEKAPKVVILKKATAYILSVQAEEQKLISEEDLLRKRREQLKHKLEQLRNSCA

SEQ ID NO: 12-52 - skipped (41 entries)

SEQ ID NO: 53 - protein, 196 aa, Homo sapiens
QLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINF

SEQ ID NO: 54 - protein, 36 aa, Homo sapiens
  MOD_RES (12)..(13): Any naturally occurring amino acid
LTPEQVVAIASXXGGKQALETVQRLLPVLCQAHGGG

SEQ ID NO: 55 - protein, 36 aa, Homo sapiens
  MOD_RES (12)..(13): Any naturally occurring amino acid
LTPEQVVAIASXXGGKQALETVQRLLPVLCQAGHGG

SEQ ID NO: 56 - protein, 36 aa, Homo sapiens
  MOD_RES (12)..(13): Any naturally occurring amino acid
LTPEQVVAIASXXGGKQALETVQRLLPVLCQAHGSG

SEQ ID NO: 57 - protein, 1089 aa, Homo sapiens
  MOD_RES (188)..(189): Any naturally occurring amino acid
  MOD_RES (224)..(225): Any naturally occurring amino acid
  MOD_RES (258)..(259): Any naturally occurring amino acid
  MOD_RES (294)..(295): Any naturally occurring amino acid
  MOD_RES (328)..(329): Any naturally occurring amino acid
  MOD_RES (364)..(365): Any naturally occurring amino acid
  MOD_RES (398)..(399): Any naturally occurring amino acid
  MOD_RES (434)..(435): Any naturally occurring amino acid
  MOD_RES (468)..(469): Any naturally occurring amino acid
  MOD_RES (504)..(505): Any naturally occurring amino acid
  MOD_RES (538)..(539): Any naturally occurring amino acid
  MOD_RES (574)..(575): Any naturally occurring amino acid
  MOD_RES (608)..(609): Any naturally occurring amino acid
  MOD_RES (644)..(645): Any naturally occurring amino acid
  MOD_RES (678)..(679): Any naturally occurring amino acid
  MOD_RES (714)..(715): Any naturally occurring amino acid
  MOD_RES (748)..(749): Any naturally occurring amino acid
  MOD_RES (784)..(785): Any naturally occurring amino acid
  MOD_RES (818)..(819): Any naturally occurring amino acid
MDYKDHDGDYKDHDIDYKDDDDKMAPKKKRKVGIHGVPAAVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGRPALESIVAQLSRPDPALAALTNDHLVALACLGGRPALDAVKKGLPHAPALIKRTNRRIPERTSHRVAGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 58 - protein, 1107 aa, Homo sapiens
  MOD_RES (188)..(189): Any naturally occurring amino acid
  MOD_RES (224)..(225): Any naturally occurring amino acid
  MOD_RES (260)..(261): Any naturally occurring amino acid
  MOD_RES (296)..(297): Any naturally occurring amino acid
  MOD_RES (332)..(333): Any naturally occurring amino acid
  MOD_RES (368)..(369): Any naturally occurring amino acid
  MOD_RES (404)..(405): Any naturally occurring amino acid
  MOD_RES (440)..(441): Any naturally occurring amino acid
  MOD_RES (476)..(477): Any naturally occurring amino acid
  MOD_RES (512)..(513): Any naturally occurring amino acid
  MOD_RES (548)..(549): Any naturally occurring amino acid
  MOD_RES (584)..(585): Any naturally occurring amino acid
  MOD_RES (620)..(621): Any naturally occurring amino acid
  MOD_RES (656)..(657): Any naturally occurring amino acid
  MOD_RES (692)..(693): Any naturally occurring amino acid
  MOD_RES (728)..(729): Any naturally occurring amino acid
  MOD_RES (764)..(765): Any naturally occurring amino acid
  MOD_RES (800)..(801): Any naturally occurring amino acid
  MOD_RES (836)..(837): Any naturally occurring amino acid
MDYKDHDGDYKDHDIDYKDDDDKMAPKKKRKVGIHGVPAAVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGRPALESIVAQLSRPDPALAALTNDHLVALACLGGRPALDAVKKGLPHAPALIKRTNRRIPERTSHRVAGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 59 - protein, 1086 aa, Homo sapiens
  MOD_RES (188)..(189): Any naturally occurring amino acid
  MOD_RES (224)..(225): Any naturally occurring amino acid
  MOD_RES (258)..(259): Any naturally occurring amino acid
  MOD_RES (294)..(295): Any naturally occurring amino acid
  MOD_RES (328)..(329): Any naturally occurring amino acid
  MOD_RES (364)..(365): Any naturally occurring amino acid
  MOD_RES (398)..(399): Any naturally occurring amino acid
  MOD_RES (434)..(435): Any naturally occurring amino acid
  MOD_RES (468)..(469): Any naturally occurring amino acid
  MOD_RES (504)..(505): Any naturally occurring amino acid
  MOD_RES (538)..(539): Any naturally occurring amino acid
  MOD_RES (574)..(575): Any naturally occurring amino acid
  MOD_RES (608)..(609): Any naturally occurring amino acid
  MOD_RES (644)..(645): Any naturally occurring amino acid
  MOD_RES (678)..(679): Any naturally occurring amino acid
  MOD_RES (714)..(715): Any naturally occurring amino acid
  MOD_RES (748)..(749): Any naturally occurring amino acid
  MOD_RES (784)..(785): Any naturally occurring amino acid
  MOD_RES (818)..(819): Any naturally occurring amino acid
MDYKDHDGDYKDHDIDYKDDDDKMAPKKKRKVGIHGVPAAVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGRPALESIVAQLSRPDPALAALTNDHLVALACLGGRPALDAVKKGLPHAPALIKRTNRRIPERTSHRVAGSVLEKSDIEKFKNQLRTELTNIDHSYLKGIDIASKKKTSNVENTEFEAISTKIFTDELGFSGKHLGGSNKPDGLLWDDDCAIILDSKAYSEGFPLTASHTDAMGRYLRQFTERKEEIKPTWWDIAPEHLDNTYFAYVSGSFSGNYKEQLQKFRQDTNHLGGALEFVKLLLLANNYKTQKMSKKEVKKSILDYNISY

SEQ ID NO: 60 - protein, 1104 aa, Homo sapiens
  MOD_RES (188)..(189): Any naturally occurring amino acid
  MOD_RES (224)..(225): Any naturally occurring amino acid
  MOD_RES (260)..(261): Any naturally occurring amino acid
  MOD_RES (296)..(297): Any naturally occurring amino acid
  MOD_RES (332)..(333): Any naturally occurring amino acid
  MOD_RES (368)..(369): Any naturally occurring amino acid
  MOD_RES (404)..(405): Any naturally occurring amino acid
  MOD_RES (440)..(441): Any naturally occurring amino acid
  MOD_RES (476)..(477): Any naturally occurring amino acid
  MOD_RES (512)..(513): Any naturally occurring amino acid
  MOD_RES (548)..(549): Any naturally occurring amino acid
  MOD_RES (584)..(585): Any naturally occurring amino acid
  MOD_RES (620)..(621): Any naturally occurring amino acid
  MOD_RES (656)..(657): Any naturally occurring amino acid
  MOD_RES (692)..(693): Any naturally occurring amino acid
  MOD_RES (728)..(729): Any naturally occurring amino acid
  MOD_RES (764)..(765): Any naturally occurring amino acid
  MOD_RES (800)..(801): Any naturally occurring amino acid
  MOD_RES (836)..(837): Any naturally occurring amino acid
MDYKDHDGDYKDHDIDYKDDDDKMAPKKKRKVGIHGVPAAVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGRPALESIVAQLSRPDPALAALTNDHLVALACLGGRPALDAVKKGLPHAPALIKRTNRRIPERTSHRVAGSVLEKSDIEKFKNQLRTELTNIDHSYLKGIDIASKKKTSNVENTEFEAISTKIFTDELGFSGKHLGGSNKPDGLLWDDDCAIILDSKAYSEGFPLTASHTDAMGRYLRQFTERKEEIKPTWWDIAPEHLDNTYFAYVSGSFSGNYKEQLQKFRQDTNHLGGALEFVKLLLLANNYKTQKMSKKEVKKSILDYNISY

SEQ ID NO: 61-99 - skipped (39 entries)

SEQ ID NO: 100 - protein, 1273 aa, Artificial Sequence
  Synthetic Sequence
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 101 - protein, 75 aa, Artificial Sequence
  Synthetic Sequence
MYSFVSEETGTLIVNSVLLFLAFVVFLLVTLAILTALRLCAYCCNIVNVSLVKPSFYVYSRVKNLNSSRVPDLLV

SEQ ID NO: 102 - protein, 222 aa, Artificial Sequence
  Synthetic Sequence
MADSNGTITVEELKKLLEQWNLVIGFLFLTWICLLQFAYANRNRFLYIIKLIFLWLLWPVTLACFVLAAVYRINWITGGIAIAMACLVGLMWLSYFIASFRLFARTRSMWSFNPETNILLNVPLHGTILTRPLLESELVIGAVILRGHLRIAGHHLGRCDIKDLPKEITVATSRTLSYYKLGASQRVAGDSGFAAYSRYRIGNYKLNTDHSSSSDNIALLVQ

SEQ ID NO: 103 - protein, 419 aa, Artificial Sequence
  Synthetic Sequence
MSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQA

SEQ ID NO: 104-168 - skipped (65 entries)

SEQ ID NO: 169 - protein, 986 aa, Homo sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEAACGGFLTKLNGSITSPGWPKEYPPNKNCIWQLVAPTQYRISLQFDFFETEGNDVCKYDFVEVRSGLTADSKLHGKFCGSEKPEVITSQYNNMRVEFKSDNTVSKKGFKAHFFSDKDECSKDNGGCQQDCVNTFGSYECQCRSGFVLHDNKHDCKEAGCDHKVTSTSGTITSPNWPDKYPSKKECTWAISSTPGHRVKLTFMEMDIESQPECAYDHLEVFDGRDAKAPVLGRFCGSKKPEPVLATGSRMFLRFYSDNSVQRKGFQASHATECGGQVRADVKTKDLYSHAQFGDNNYPGGVDCEWVIVAEEGYGVELVFQTFEVEEETDCGYDYMELFDGYDSTAPRLGRYCGSGPPEEVYSAGDSVLVKFHSDDTITKKGFHLRYTSTKFQDTLHSRK

SEQ ID NO: 170 - protein, 396 aa, Homo sapiens
MVAGTRCLLALLLPQVLLGGAAGLVPELGRRKFAAASSGRPSSQPSDEVLSEFELRLLSMFGLKQRPTPSRDAVVPPYMLDLYRRHSGQPGSPAPDHRLERAASRANTVRSFHHEESLEELPETSGKTTRRFFFNLSSIPTEEFITSAELQVFREQMQDALGNNSSFHHRINIYEIIKPATANSKFPVTRLLDTRLVNQNASRWESFDVTPAVMRWTAQGHANHGFVVEVAHLEEKQGVSKRHVRISRSLHQDEHSWSQIRPLLVTFGHDGKGHPLHKREKRQAKHKQRKRLKSSCKRHPLYVDFSDVGWNDWIVAPPGYHAFYCHGECPFPLADHLNSTNHAIVQTLVNSVNSKIPKACCVPTELSAISMLYLDENEKVVLKNYQDMVVEGCGCR

SEQ ID NO: 171 - protein, 408 aa, Homo sapiens
MIPGNRMLMVVLLCQVLLGGASHASLIPETGKKKVAEIQGHAGGRRSGQSHELLRDFEATLLQMFGLRRRPQPSKSAVIPDYMRDLYRLQSGEEEEEQIHSTGLEYPERPASRANTVRSFHHEEHLENIPGTSENSAFRFLFNLSSIPENEVISSAELRLFREQVDQGPDWERGFHRINIYEVMKPPAEVVPGHLITRLLDTRLVHHNVTRWETFDVSPAVLRWTREKQPNYGLAIEVTHLHQTRTHQGQHVRISRSLPQGSGNWAQLRPLLVTFGHDGRGHALTRRRRAKRSPKHHSQRARKKNKNCRRHSLYVDFSDVGWNDWIVAPPGYQAFYCHGDCPFPLADHLNSTNHAIVQTLVNSVNSSIPKACCVPTELSAISMLYLDEYDKVVLKNYQEMVVEGCGCR

SEQ ID NO: 172 - protein, 408 aa, Homo sapiens; identical to SEQ ID NO: 171

SEQ ID NO: 173 - protein, 454 aa, Homo sapiens
MHLTVFLLKGIVGFLWSCWVLVGYAKGGLGDNHVHSSFIYRRLRNHERREIQREILSILGLPHRPRPFSPGKQASSAPLFMLDLYNAMTNEENPEESEYSVRASLAEETRGARKGYPASPNGYPRRIQLSRTTPLTTQSPPLASLHDTNFLNDADMVMSFVNLVERDKDFSHQRRHYKEFRFDLTQIPHGEAVTAAEFRIYKDRSNNRFENETIKISIYQIIKEYTNRDADLFLLDTRKAQALDVGWLVFDITVTSNHWVINPQNNLGLQLCAETGDGRSINVKSAGLVGRQGPQSKQPFMVAFFKASEVLLRSVRAANKRKNQNRNKSSSHQDSSRMSSVGDYNTSEQKQACKKHELYVSFRDLGWQDWIIAPEGYAAFYCDGECSFPLNAHMNATNHAIVQTLVHLMFPDHVPKPCCAPTKLNAISVLYFDDSSNVILKKYRNMVVRSCGCH

SEQ ID NO: 174 - protein, 513 aa, Homo sapiens
MPGLGRRAQWLCWWWGLLCSCCGPPPLRPPLPAAAAAAAGGQLLGDGGSPGRTEQPPPSPQSSSGFLYRRLKTQEKREMQKEILSVLGLPHRPRPLHGLQQPQPPALRQQEEQQQQQQLPRGEPPPGRLKSAPLFMLDLYNALSADNDEDGASEGERQQSWPHEAASSSQRRQPPPGAAHPLNRKSLLAPGSGSGGASPLTSAQDSAFLNDADMVMSFVNLVEYDKEFSPRQRHHKEFKFNLSQIPEGEVVTAAEFRIYKDCVMGSFKNQTFLISIYQVLQEHQHRDSDLFLLDTRVVWASEEGWLEFDITATSNLWVVTPQHNMGLQLSVVTRDGVHVHPRAAGLVGRDGPYDKQPFMVAFFKVSEVHVRTTRSASSRRRQQSRNRSTQSQDVARVSSASDYNSSELKTACRKHELYVSFQDLGWQDWIIAPKGYAANYCDGECSFPLNAHMNATNHAIVQTLVHLMNPEYVPKPCCAPTKLNAISVLYFDDNSNVILKKYRNMVVRACGCH

SEQ ID NO: 175 - protein, 431 aa, Homo sapiens
MHVRSLRAAAPHSFVALWAPLFLLRSALADFSLDNEVHSSFIHRRLRSQERREMQREILSILGLPHRPRPHLQGKHNSAPMFMLDLYNAMAVEEGGGPGGQGFSYPYKAVFSTQGPPLASLQDSHFLTDADMVMSFVNLVEHDKEFFHPRYHHREFRFDLSKIPEGEAVTAAEFRIYKDYIRERFDNETFRISVYQVLQEHLGRESDLFLLDSRTLWASEEGWLVFDITATSNHWVVNPRHNLGLQLSVETLDGQSINPKLAGLIGRHGPQNKQPFMVAFFKATEVHFRSIRSTGSKQRSQNRSKTPKNQEALRMANVAENSSSDQRQACKKHELYVSFRDLGWQDWIIAPEGYAAYYCEGECAFPLNSYMNATNHAIVQTLVHFINPETVPKPCCAPTQLNAISVLYFDDSSNVILKKYRNMVVRACGCH

SEQ ID NO: 176 - protein, 402 aa, Homo sapiens
MTALPGPLWLLGLALCALGGGGPGLRPPPGCPQRRLGARERRDVQREILAVLGLPGRPRPRAPPAASRLPASAPLFMLDLYHAMAGDDDEDGAPAERRLGRADLVMSFVNMVERDRALGHQEPHWKEFRFDLTQIPAGEAVTAAEFRIYKVPSIHLLNRTLHVSMFQVVQEQSNRESDLFFLDLQTLRAGDEGWLVLDVTAASDCWLLKRHKDLGLRLYVETEDGHSVDPGLAGLLGQRAPRSQQPFVVTFFRASPSPIRTPRAVRPLRRRQPKKSNELPQANRLPGIFDDVHGSHGRQVCRRHELYVSFQDLGWLDWVIAPQGYSAYYCEGECSFPLDSCMNATNHAILQSLVHLMMPDAVPKACCAPTKLSATSVLYYDSSNNVILRKHRNMVVKACGCH

SEQ ID NO: 177 - protein, 372 aa, Homo sapiens
MPPPQQGPCGHHLLLLLALLLPSLPLTRAPVPPGPAAALLQALGLRDEPQGAPRLRPVPPVMWRLFRRRDPQETRSGSRRTSPGVTLQPCHVEELGVAGNIVRHIPDRGAPTRASEPASAAGHCPEWTVVFDLSAVEPAERPSRARLELRFAAAAAAAPEGGWELSVAQAGQGAGADPGPVLLRQLVPALGPPVRAELLGAAWARNASWPRSLRLALALRPRAPAACARLAEASLLLVTLDPRLCHPLARPRRDAEPVLGGGPGGACRARRLYVSFREVGWHRWVIAPRGFLANYCQGQCALPVALSGSGGPPALNHAVLRALMHAAAPGAADLPCCVPARLSPISVLFFDNSDNVVLRQYEDMVVDECGCR

SEQ ID NO: 178 - protein, 429 aa, Homo sapiens
MCPGALWVALPLLSLLAGSLQGKPLQSWGRGSAGGNAHSPLGVPGGGLPEHTFNLKMFLENVKVDFLRSLNLSGVPSQDKTRVEPPQYMIDLYNRYTSDKSTTPASNIVRSFSMEDAISITATEDFPFQKHILLFNISIPRHEQITRAELRLYVSCQNHVDPSHDLKGSVVIYDVLDGTDAWDSATETKTFLVSQDIQDEGWETLEVSSAVKRWVRSDSTKSKNKLEVTVESHRKGCDTLDISVPPGSRNLPFFVVFSNDHSSGTKETRLELREMISHEQESVLKKLSKDGSTEAGESSHEEDTDGHVAAGSTLARRKRSAGAGSHCQKTSLRVNFEDIGWDSWIIAPKEYEAYECKGGCFFPLADDVTPTKHAIVQTLVHLKFPTKVGKACCVPTKLSPISVLYKDDMGVPTLKYHYEGMSVAECGCR

SEQ ID NO: 179 - protein, 424 aa, Homo sapiens
MGSLVLTLCALFCLAAYLVSGSPIMNLEQSPLEEDMSLFGDVFSEQDGVDFNTLLQSMKDEFLKTLNLSDIPTQDSAKVDPPEYMLELYNKFATDRTSMPSANIIRSFKNEDLFSQPVSFNGLRKYPLLFNVSIPHHEEVIMAELRLYTLVQRDRMIYDGVDRKITIFEVLESKGDNEGERNMLVLVSGEIYGTNSEWETFDVTDAIRRWQKSGSSTHQLEVHIESKHDEAEDASSGRLEIDTSAQNKHNPLLIVFSDDQSSDKERKEELNEMISHEQLPELDNLGLDSFSSGPGEEALLQMRSNIIYDSTARIRRNAKGNYCKRTPLYIDFKEIGWDSWIIAPPGYEAYECRGVCNYPLAEHLTPTKHAIIQALVHLKNSQKASKACCVPTKLEPISILYLDKGVVTYKFKYEGMAVSECGCR

SEQ ID NO: 180 - protein, 450 aa, Homo sapiens
MDLSAAAALCLWLLSACRPRDGLEAAAVLRAAGAGPVRSPGGGGGGGGGGRTLAQAAGAAAVPAAAVPRARAARRAAGSGFRNGSVVPHHFMMSLYRSLAGRAPAGAAAVSASGHGRADTITGFTDQATQDESAAETGQSFLFDVSSLNDADEVVGAELRVLRRGSPESGPGSWTSPPLLLLSTCPGAARAPRLLYSRAAEPLVGQRWEAFDVADAMRRHRREPRPPRAFCLLLRAVAGPVPSPLALRRLGFGWPGGGGSAAEERAVLVVSSRTQRKESLFREIRAQARALGAALASEPLPDPGTGTASPRAVIGGRRRRRTALAGTRTAQGSGGGAGRGHGRRGRSRCSRKPLHVDFKELGWDDWIIAPLDYEAYHCEGLCDFPLRSHLEPTNHAIIQTLLNSMAPDAAPASCCVPARLSPISILYIDAANNVVYKQYEDMVVEACGCR

SEQ ID NO: 181 - protein, 392 aa, Homo sapiens
MVLLSILRILFLCELVLFMEHRAQMAEGGQSSIALLAEAPTLPLIEELLEESPGEQPRKPRLLGHSLRYMLELYRRSADSHGHPRENRTIGATMVRLVKPLTNVARPHRGTWHIQILGFPLRPNRGLYQLVRATVVYRHHLQLTRFNLSCHVEPWVQKNPTNHFPSSEGDSSKPSLMSNAWKEMDITQLVQQRFWNNKGHRILRLRFMCQQQKDSGGLELWHGTSSLDIAFLLLYFNDTHKSIRKAKFLPRGMEEFMERESLLRRTRQADGISAEVTASSSKHSGPENNQCSLHPFQISFRQLGWDHWIIAPPFYTPNYCKGTCLRVLRDGLNSPNHAIIQNLINQLVDQSVPRPSCVPYKYVPISVLMIEANGSILYKEYEGMIAESCTCR

SEQ ID NO: 182 - protein, 366 aa, Homo sapiens [sequence omitted]

SEQ ID NO: 183 - protein, 366 aa, Homo sapiens
MWPLWLCWALWVLPLAGPGAALTEEQLLGSLLRQLQLSEVPVLDRADMEKLVIPAHVRAQYVVLLRRSHGDRSRGKRFSQSFREVAGRFLASEASTHLLVFGMEQRLPPNSELVQAVLRLFQEPVPKAALHRHGRLSPRSAQARVTVEWLRVRDDGSNRTSLIDSRLVSVHESGWKAFDVTEAVNFWQQLSRPRQPLLLQVSVQREHLGPLASGAHKLVRFASQGAPAGLGEPQLELHTLDLRDYGAQGDCDPEAPMTEGTRCCRQEMYIDLQGMKWAKNWVLEPPGFLAYECVGTCQQPPEALAFNWPFLGPRQCIASETASLPMIVSIKEGGRTRPQVVSLPNMRVQKCSCASDGALVPRRLQP

SEQ ID NO: 184 - protein, 366 aa, Homo sapiens
MVLHLLLFLLLTPQGGHSCQGLELARELVLAKVRALFLDALGPPAVTREGGDPGVRRLPRRHALGGFTHRGSEPEEEEDVSQAILFPATDASCEDKSAARGLAQEAEEGLFRYMFRPSQHTRSRQVTSAQLWFHTGLDRQGTAASNSSEPLLGLLALSPGGPVAVPMSLGHAPPHWAVLHLATSALSLLTHPVLVLLLRCPLCTCSARPEATPFLVAHTRTRPPSGGERARRSTPLMSWPWSPSALRLLQRPPEEPAAHANCHRVALNISFQELGWERWIVYPPSFIFHYCHGGCGLHIPPNLSLPVPGAPPTPAQPYSLLPGAQPCCAALPGTMRPLHVRTTSDGGYSFKYETVPNLLTQHCACI

SEQ ID NO: 185 - protein, 426 aa, Homo sapiens
MPLLWLRGFLLASCWIIVRSSPTPGSEGHSAAPDCPSCALAALPKDVPNSQPEMVEAVKKHILNMLHLKKRPDVTQPVPKAALLNAIRKLHVGKVGENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRRRGLECDGKVNICCKKQFFVSFKDIGWNDWIIAPSGYHANYCEGECPSHIAGTSGSSLSFHSTVINHYRMRGHSPFANLKSCCVPTKLRPMSMLYYDDGQNIIKKDIQNMIVEECGCS

SEQ ID NO: 186 - protein, 407 aa, Homo sapiens
MDGLPGRALGAACLLLLAAGWLGPEAWGSPTPPPTPAAPPPPPPPGSPGGSQDTCTSCGGFRRPEELGRVDGDFLEAVKRHILSRLQMRGRPNITHAVPKAAMVTALRKLHAGKVREDGRVEIPHLDGHASPGADGQERVSEIISFAETDGLASSRVRLYFFISNEGNQNLFVVQASLWLYLKLLPYVLEKGSRRKVRVKVYFQEQGHGDRWNMVEKRVDLKRSGWHTFPLTEAIQALFERGERRLNLDVQCDSCQELAVVPVFVDPGEESHRPFVVVQARLGDSRHRIRKRGLECDGRTNLCCRQQFFIDFRLIGWNDWIIAPTGYYGNYCEGSCPAYLAGVPGSASSFHTAVVNQYRMRGLNPGTVNSCCIPTKLSTMSMLYFDDEYNIVKRDVPNMIVEECGCA

SEQ ID NO: 187 - protein, 267 aa, Homo sapiens
MHLLLFQLLVLLPLGKTTRHQDGRQNQSSLSPVLLPRNQRELPTGNHEEAEEKPDLFVAVPHLVATSPAGEGQRQREKMLSRFGRFWKKPEREMHPSRDSDSEPFPPGTQSLIQPIDGMKMEKSPLREEAKKFWHHFMFRKTPASQGVILPIKSHEVHWETCRTVPFSQTITHEGCEKVVVQNNLCFGKCGSVHFPGAAQHSHTSCSHCLPAKFTTMHLPLNCTELSSVIKVVMLVEECQCKVKTEHEDGHILHAGSQDSFIPGVSA

SEQ ID NO: 188 - protein, 1038 aa, Homo sapiens
MTSSLQRPWRVPWLPWTILLVSTAAASQNQERLCAFKDPYQQDLGIGESRISHENGTILCSKGSTCYGLWEKSKGDINLVKQGCWSHIGDPQECHYEECVVTTTPPSIQNGTYRFCCCSTDLCNVNFTENFPPPDTTPLSPPHSFNRDETIIIALASVSVLAVLIVALCFGYRMLTGDRKQGLHSMNMMEAAASEPSLDLDNLKLLELIGRGRYGAVYKGSLDERPVAVKVFSFANRQNFINEKNIYRVPLMEHDNIARFIVGDERVTADGRMEYLLVMEYYPNGSLCKYLSLHTSDWVSSCRLAHSVTRGLAYLHTELPRGDHYKPAISHRDLNSRNVLVKNDGTCVISDFGLSMRLTGNRLVRPGEEDNAAISEVGTIRYMAPEVLEGAVNLRDCESALKQVDMYALGLIYWEIFMRCTDLFPGESVPEYQMAFQTEVGNHPTFEDMQVLVSREKQRPKFPEAWKENSLAVRSLKETIEDCWDQDAEARLTAQCAEERMAELMMIWERNKSVSPTVNPMSTAMQNERNLSHNRRVPKIGPYPDYSSSSYIEDSIHHTDSIVKNISSEHSMSSTPLTIGEKNRNSINYERQQAQARIPSPETSVTSLSTNTTTTNTTGLTPSTGMTTISEMPYPDETNLHTTNVAQSIGPTPVCLQLTEEDLETNKLDPKEVDKNLKESSDENLMEHSLKQFSGPDPLSSTSSSLLYPLIKLAVEATGQQDFTQTANGQACLIPDVLPTQIYPLPKQQNLPKRPTSLPLNTKNSTKEPRLKFGSKHKSNLKQVETGVAKMNTINAAEPHVVTVTMNGVAGRNHSVNSHAATTQYANGTVLSGQTTNIVTHRAQEMLQNQFIGEDTRLNINSSPDEHEPLLRREQQAGHDEGVLDRLVDRRERPLEGGRTNSNNNNSNPCSEQDVLAQGVPSTAADPGPSKPRRAQRPNSLDLSATNVLDGSSIQIGESTQDGKSGSGEKIKKRVKTPYSLKRWRPSTWVISTESLDCEVNNNGSNRAVHSKSSTAVYLAEGGTATTMVSKDIGMNCL

SEQ ID NO: 189 - protein, 794 aa, Homo sapiens
MELRPWLLWVVAATGTLVLLAADAQGQKVFTNTWAVRIPGGPAVANSVARKHGFLNLGQIFGDYYHFWHRGVTKRSLSPHRPRHSRLQREPQVQWLEQQVAKRRTKRDVYQEPTDPKFPQQWYLSGVTQRDLNVKAAWAQGYTGHGIVVSILDDGIEKNHPDLAGNYDPGASFDVNDQDPDPQPRYTQMNDNRHGTRCAGEVAAVANNGVCGVGVAYNARIGGVRMLDGEVTDAVEARSLGLNPNHIHIYSASWGPEDDGKTVDGPARLAEEAFFRGVSQGRGGLGSIFVWASGNGGREHDSCNCDGYTNSIYTLSISSATQFGNVPWYSEACSSTLATTYSSGNQNEKQIVTTDLRQKCTESHTGTSASAPLAAGIIALTLEANKNLTWRDMQHLVVQTSKPAHLNANDWATNGVGRKVSHSYGYGLLDAGAMVALAQNWTTVAPQRKCIIDILTEPKDIGKRLEVRKTVTACLGEPNHITRLEHAQARLTLSYNRRGDLAIHLVSPMGTRSTLLAARPHDYSADGFNDWAFMTTHSWDEDPSGEWVLEIENTSEANNYGTLTKFTLVLYGTAPEGLPVPPESSGCKTLTSSQACVVCEEGFSLHQKSCVQHCPPGFAPQVLDTHYSTENDVETIRASVCAPCHASCATCQGPALTDCLSCPSHASLDPVEQTCSRQSQSSRESPPQQQPPRLPPEVEAGQRLRAGLLPSHLPEVVAGLSCAFIVLVFVTVFLVLQLRSGFSFRGVKVYTMDRGLISYKGLPPEAWQEECPSDSEEDEGRGERTAFIKDQSAL

SEQ ID NO: 190 - protein, 390 aa, Homo sapiens
MPPSGLRLLLLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 191 - protein, 414 aa, Homo sapiens
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 192 - protein, 202 aa, Homo sapiens
MLVAGFLLALPPSWAAGAPRAGRRPARPRGCADRPEELLEQLYGRLAAGVLSAFHHTLQLGPREQARNASCPAGGRPADRRFRPPTNLRSVSPWAYRISYDPARYPRYLPEAYCLCRGCLTGLFGEEDVRFRSAPVYMPTVVLRRTPACAGGRSVYTEAYVTIPVGCTCVPEPEKDADSINSSIDKQGAKLLLGPNDAPAGP

SEQ ID NO: 193 - protein, 1821 aa, Homo sapiens
MRPRTKARSPGRALRNPWRGFLPLTLALFVGAGHAQRDPVGRYEPAGGDANRLRRPGGSYPAAAAAKVYSLFREQDAPVAGLQPVERAQPGWGSPRRPTEAEARRPSRAQQSRRVQPPAQTRRSTPLGQQQPAPRTRAAPALPRLGTPQRSGAAPPTPPRGRLTGRNVCGGQCCPGWTTANSTNHCIKPVCEPPCQNRGSCSRPQLCVCRSGFRGARCEEVIPDEEFDPQNSRLAPRRWAERSPNLRRSSAAGEGTLARAQPPAPQSPPAPQSPPAGTLSGLSQTHPSQQHVGLSRTVRLHPTATASSQLSSNALPPGPGLEQRDGTQQAVPLEHPSSPWGLNLTEKIKKIKIVFTPTICKQTCARGHCANSCERGDTTTLYSQGGHGHDPKSGFRIYFCQIPCLNGGRCIGRDECWCPANSTGKFCHLPIPQPDREPPGRGSRPRALLEAPLKQSTFTLPLSNQLASVNPSLVKVHIHHPPEASVQIHQVAQVRGGVEEALVENSVETRPPPWLPASPGHSLWDSNNIPARSGEPPRPLPPAAPRPRGLLGRCYLNTVNGQCANPLLELTTQEDCCGSVGAFWGVTLCAPCPPRPASPVIENGQLECPQGYKRLNLTHCQDINECLTLGLCKDAECVNTRGSYLCTCRPGLMLDPSRSRCVSDKAISMLQGLCYRSLGPGTCTLPLAQRITKQICCCSRVGKAWGSECEKCPLPGTEAFREICPAGHGYTYASSDIRLSMRKAEEEELARPPREQGQRSSGALPGPAERQPLRVVTDTWLEAGTIPDKGDSQAGQVTTSVTHAPAWVTGNATTPPMPEQGIAEIQEEQVTPSTDVLVTLSTPGIDRCAAGATNVCGPGTCVNLPDGYRCVCSPGYQLHPSQAYCTDDNECLRDPCKGKGRCINRVGSYSCFCYPGYTLATSGATQECQDINECEQPGVCSGGQCTNTEGSYHCECDQGYIMVRKGHCQDINECRHPGTCPDGRCVNSPGSYTCLACEEGYRGQSGSCVDVNECLTPGVCAHGKCTNLEGSFRCSCEQGYEVTSDEKGCQDVDECASRASCPTGLCLNTEGSFACSACENGYWVNEDGTACEDLDECAFPGVCPSGVCTNTAGSFSCKDCDGGYRPSPLGDSCEDVDECEDPQSSCLGGECKNTVGSYQCLCPQGFQLANGTVCEDVNECMGEEHCAPHGECLNSHGSFFCLCAPGFVSAEGGTSCQDVDECATTDPCVGGHCVNTEGSFNCLCETGFQPSPESGECVDIDECEDYGDPVCGTWKCENSPGSYRCVLGCQPGFHMAPNGDCIDIDECANDTMCGSHGFCDNTDGSFRCLCDQGFEISPSGWDCVDVNECELMLAVCGAALCENVEGSFLCLCASDLEEYDAQEGHCRPRGAGGQSMSEAPTGDHAPAPTRMDCYSGQKGHAPCSSVLGRNTTQAECCCTQGASWGDACDLCPSEDSAEFSEICPSGKGYIPVEGAWTFGQTMYTDADECVIFGPGLCPNGRCLNTVPGYVCLCNPGFHYDASHKKCEDHDECQDLACENGECVNTEGSFHCFCSPPLTLDLSQQRCMNSTSSTEDLPDHDIHMDICWKKVTNDVCSEPLRGHRTTYTECCCQDGEAWSQQCALCPPRSSEVYAQLCNVARIEAEREAGVHFRPGYEYGPGPDDLHYSIYGPDGAPFYNYLGPEDTVPEPAFPNTAGHSADRTPILESPLQPSELQPHYVASHPEPPAGFEGLQAEECGILNGCENGRCVRVREGYTCDCFEGFQLDAAHMACVDVNECDDLNGPAVLCVHGYCENTEGSYRCHCSPGYVAEAGPPHCTAKE

SEQ ID NO: 194 - protein, 501 aa, Homo sapiens
MRLPKLLTFLLWYLAWLDLEFICTVLGAPDLGQRPQGTRPGLAKAEAKERPPLARNVFRPGGHSYGGGATNANARAKGGTGQTGGLTQPKKDEPKKLPPRPGGPEPKPGHPPQTRQATARTVTPKGQLPGGKAPPKAGSVPSSFLLKKAREPGPPREPKEPFRPPPITPHEYMLSLYRTLSDADRKGGNSSVKLEAGLANTITSFIDKGQDDRGPVVRKQRYVFDISALEKDGLLGAELRILRKKPSDTAKPAAPGGGRAAQLKLSSCPSGRQPASLLDVRSVPGLDGSGWEVFDIWKLFRNFKNSAQLCLELEAWERGRAVDLRGLGFDRAARQVHEKALFLVFGRTKKRDLFFNEIKARSGQDDKTVYEYLFSQRRKRRAPLATRQGKRPSKNLKARCSRKALHVNFKDMGWDDWIIAPLEYEAFHCEGLCEFPLRSHLEPTNHAVIQTLMNSMDPESTPPTCCVPTRLSPISILFIDSANNVVYKQYEDMVVESCGCR

SEQ ID NO: 195 - protein, 184 aa, Homo sapiens
MSRTAYTVGALLLLLGTLLPAAEGKKKGSQGAIPPPDKAQHNDSEQTQSPQQPGSRNRGRGQGRGTAMPGEEVLESSQEALHVTERKYLKRDWCKTQPLKQTIHEEGCNSRTIINRFCYGQCNSFYIPRHIRKEEGSFQSCSFCKPKKFTTMMVTLNCPELQPPTKKKRVTRVKQCRCISIDLD

SEQ ID NO: 196 - protein, 108 aa, Homo sapiens
MKALCLLLLPVLGLLVSSKTLCSMEEAINERIQEVAGSLIFRAISSIGLECQSVTSRGDLATCPRGFAVTGCTCGSACGSWDVRAETTCHCQCAGMDWTGARCCRVQP

SEQ ID NO: 197 - protein, 323 aa, Homo sapiens
MAYVPAPGYQPTYNPTLPYYQPIPGGLNVGMSVYIQGVASEHMKRFFVNFVVGQDPGSDVAFHFNPRFDGWDKVVFNTLQGGKWGSEERKRSMPFKKGAAFELVFIVLAEHYKVVVNGNPFYEYGHRLPLQMVTHLQVDGDLQLQSINFIGGQPLRPQGPPMMPPYPGPGHCHQQLNSLPTMEGPPTFNPPVPYFGRLQGGLTARRTIIIKGYVPPTGKSFAINFKVGSSGDIALHINPRMGNGTVVRNSLLNGSWGSEEKKITHNPFGPGQFFDLSIRCGLDRFKVYANGQHLFDFAHRLSAFQRVDTLEIQGDVTLSYVQI

SEQ ID NO: 198 - protein, 244 aa, Homo sapiens
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLFTYDQYQENNVDQASGSVLLHLEVGDQVWLQVYGEGERNGLYADNDNDSTFTGFLLYHDTN

SEQ ID NO: 199 - protein, 245 aa, Homo sapiens
MDVGPSSLPHLGLKLLLLLLLLPLRGQANTGCYGIPGMPGLPGAPGKDGYDGLPGPKGEPGIPAIPGIRGPKGQKGEPGLPGHPGKNGPMGPPGMPGVPGPMGIPGEPGEEGRYKQKFQSVFTVTRQTHQPPAPNSLIRFNAVLTNPQGDYDTSTGKFTCKVPGLYYFVYHASHTANLCVLLYRSGVKVVTFCGHTSKTNQVNSGGVLLRLQVGEEVWLAVNDYYDMVGIQGSDSVFSGFLLFPD

SEQ ID NO: 200 - protein, 672 aa, Homo sapiens
MRAGRGATPARELFRDAAFPAADSSLFCDLSTPLAQFREDITWRRPQEICATPRLFPDDPREGQVKQGLLGDCWFLCACAALQKSRHLLDQVIPPGQPSWADQEYRGSFTCRIWQFGRWVEVTTDDRLPCLAGRLCFSRCQREDVFWLPLLEKVYAKVHGSYEHLWAGQVADALVDLTGGLAERWNLKGVAGSGGQQDRPGRWEHRTCRQLLHLKDQCLISCCVLSPRAGARELGEFHAFIVSDLRELQGQAGQCILLLRIQNPWGRRCWQGLWREGGEGWSQVDAAVASELLSQLQEGEFWVEEEEFLREFDELTVGYPVTEAGHLQSLYTERLLCHTRALPGAWVKGQSAGGCRNNSGFPSNPKFWLRVSEPSEVYIAVLQRSRLHAADWAGRARALVGDSHTSWSPASIPGKHYQAVGLHLWKVEKRRVNLPRVLSMPPVAGTACHAYDREVHLRCELSPGYYLAVPSTFLKDAPGEFLLRVFSTGRVSLSAIRAVAKNTTPGAALPAGEWGTVQLRGSWRVGQTAGGSRNFASYPTNPCFPFSVPEGPGPRCVRITLHQHCRPSDTEFHPIGFHIFQVPEGGRSQDAPPLLLQEPLLSCVPHRYAQEVSRLCLLPAGTYKVVPSTYLPDTEGAFTVTIATRIDRPSIHSQEMLGQFLQEVSIMAVMKT

SEQ ID NO: 201 - protein, 544 aa, Homo sapiens
MRAGRGATPARELFRDAAFPAADSSLFCDLSTPLAQFREDITWRRPQEICATPRLFPDDPREGQVKQGLLGDCWFLCACAALQKSRHLLDQVIPPGQPSWADQEYRGSFTCRIWQFGRWVEVTTDDRLPCLAGRLCFSRCQREDVFWLPLLEKVYAKVHGSYEHLWAGQVADALVDLTGGLAERWNLKGVAGSGGQQDRPGRWEHRTCRQLLHLKDQCLISCCVLSPRAGARELGEFHAFIVSDLRELQGQAGQCILLLRIQNPWGRRCWQGLWREGGEGWSQVDAAVASELLSQLQEGEFWVEEEEFLREFDELTVGYPVTEAGHLQSLYTERLLCHTRALPGAWVKGQSAGGCRNNSGFPSNPKFWLRVSEPSEVYIAVLQRSRLHAADWAGRARALVGDSHTSWSPASIPGKHYQAVGLHLWKVEKRRVNLPRVLSMPPVAGTACHAYDREVHLRCELSPGYYLAVPSTFLKDAPGEFLLRVFSTGRVSLRALAPAASASLCISTAGPVTPSSTPSASISSRSQRVEGARTHPHCCCRSRC

SEQ ID NO: 202 - protein, 517 aa, Homo sapiens
MRAGRGATPARELFRDAAFPAADSSLFCDLSTPLAQFREDITWRRPQEICATPRLFPDDPREGQVKQGLLGDCWFLCACAALQKSRHLLDQVIPPGQPSWADQEYRGSFTCRIWQFGRWVEVTTDDRLPCLAGRLCFSRCQREDVFWLPLLEKVYAKVHGSYEHLWAGQVADALVDLTGGLAERWNLKGVAGSGGQQDRPGRWEHRTCRQLLHLKDQCLISCCVLSPRAGARELGEFHAFIVSDLRELQGQAGQCILLLRIQNPWGRRCWQGLWREGGEGWSQVDAAVASELLSQLQEGEFWVEEEEFLREFDELTVGYPVTEAGHLQSLYTERLLCHTRALPGAWVKGQSAGGCRNNSGFPSNPKFWLRVSEPSEVYIAVLQRSRLHAADWAGRARALVGDSHTSWSPASIPGKHYQAVGLHLWKVPEGGRSQDAPPLLLQEPLLSCVPHRYAQEVSRLCLLPAGTYKVVPSTYLPDTEGAFTVTIATRIDRPSIHSQEMLGQFLQEVSIMAVMKT

SEQ ID NO: 203 - protein, 370 aa, Homo sapiens
MHRLIFVYTLICANFCSCRDTSATPQSASIKALRNANLRRDESNHLTDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNWESVTSSISGVSYNSPSVTDPTLIADALDKKIAEFDTVEDLLKYFNPESWQEDLENMYLDTPRYRGRSYHDRKSKVDLDRLNDDAKRYSCTPRNYSVNIREELKLANVVFFPRCLLVQRCGGNCGCGTVNWRSCTCNSGKTVKKYHEVLQFEPGHIKRRGRAKTMALVDIQLDHHERCDCICSSRPPR

SEQ ID NO: 204 - protein, 281 aa, Homo sapiens
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKMMSYCTTGQMWARSSYLGAVFNLTSADHLYVNVSELSLVNFEESQTFFGLYKL

SEQ ID NO: 205 - protein, 1447 aa, Homo sapiens
MASAGNAAEPQDRGGGGSGCIGAPGRPAGGGRRRRTGGLRRAAAPDRDYLHRPSYCDAAFALEQISKGKATGRKAPLWLRAKFQRLLFKLGCYIQKNCGKFLVVGLLIFGAFAVGLKAANLETNVEELWVEVGGRVSRELNYTRQKIGEEAMFNPQLMIQTPKEEGANVLTTEALLQHLDSALQASRVHVYMYNRQWKLEHLCYKSGELITETGYMDQIIEYLYPCLIITPLDCFWEGAKLQSGTAYLLGKPPLRWTNFDPLEFLEELKKINYQVDSWEEMLNKAEVGHGYMDRPCLNPADPDCPATAPNKNSTKPLDMALVLNGGCHGLSRKYMHWQEELIVGGTVKNSTGKLVSAHALQTMFQLMTPKQMYEHFKGYEYVSHINWNEDKAAAILEAWQRTYVEVVHQSVAQNSTQKVLSFTTTTLDDILKSFSDVSVIRVASGYLLMLAYACLTMLRWDCSKSQGAVGLAGVLLVALSVAAGLGLCSLIGISFNAATTQVLPFLALGVGVDDVFLLAHAFSETGQNKRIPFEDRTGECLKRTGASVALTSISNVTAFFMAALIPIPALRAFSLQAAVVVVFNFAMVLLIFPAILSMDLYRREDRRLDIFCCFTSPCVSRVIQVEPQAYTDTHDNTRYSPPPPYSSHSFAHETQITMQSTVQLRTEYDPHTHVYYTTAEPRSEISVQPVTVTQDTLSCQSPESTSSTRDLLSQFSDSSLHCLEPPCTKWTLSSFAEKHYAPFLLKPKAKVVVIFLFLGLLGVSLYGTTRVRDGLDLTDIVPRETREYDFIAAQFKYFSFYNMYIVTQKADYPNIQHLLYDLHRSFSNVKYVMLEENKQLPKMWLHYFRDWLQGLQDAFDSDWETGKIMPNNYKNGSDDGVLAYKLLVQTGSRDKPIDISQLTKQRLVDADGIINPSAFYIYLTAWVSNDPVAYAASQANIRPHRPEWVHDKADYMPETRLRIPAAEPIEYAQFPFYLNGLRDTSDFVEAIEKVRTICSNYTSLGLSSYPNGYPFLFWEQYIGLRHWLLLFISVVLACTFLVCAVFLLNPWTAGIIVMVLALMTVELFGMMGLIGIKLSAVPVVILIASVGIGVEFTVHVALAFLTAIGDKNRRAVLALEHMFAPVLDGAVSTLLGVLMLAGSEFDFIVRYFFAVLAILTILGVLNGLVLLPVLLSFFGPYPEVSPANGLNRLPTPSPEPPPSVVRFAMPPGHTHSGSDSSDSEYSSQTTVSGLSEELRHYEAQQGAGGPAHQVIVEATENPVFAHSTVVHPESRHHPPSNPRQQPHLDSGSLPPGRQGQQPRRDPPREGLWPPPYRPRRDAFEISTEGHSGPSNRARWGPRGARSHNPRNPASTAMGSSVPGYCQPITTVTASASVTVAVHPPPVPGPGRNPRGGLCPGYPETDHGLFEDPHVPFHVRCERRDSKVEVIELQDVECEERPRGSSSN

SEQ ID NO: 206 - protein, 1203 aa, Homo sapiens
MTRSPPLRELPPSYTPPARTAAPQILAGSLKAPLWLRAYFQGLLFSLGCGIQRHCGKVLFLGLLAFGALALGLRMAIIETNLEQLWVEVGSRVSQELHYTKEKLGEEAAYTSQMLIQTARQEGENILTPEALGLHLQAALTASKVQVSLYGKSWDLNKICYKSGVPLIENGMIERMIEKLFPCVILTPLDCFWEGAKLQGGSAYLPGRPDIQWTNLDPEQLLEELGPFASLEGFRELLDKAQVGQAYVGRPCLHPDDLHCPPSAPNHHSRQAPNVAHELSGGCHGFSHKFMHWQEELLLGGMARDPQGELLRAEALQSTFLLMSPRQLYEHFRGDYQTHDIGWSEEQASTVLQAWQRRFVQLAQEALPENASQQIHAFSSTTLDDILHAFSEVSAARVVGGYLLMLAYACVTMLRWDCAQSQGSVGLAGVLLVALAVASGLGLCALLGITFNAATTQVLPFLALGIGVDDVFLLAHAFTEALPGTPLQERMGECLQRTGTSVVLTSINNMAAFLMAALVPIPALRAFSLQAAIVVGCTFVAVMLVFPAILSLDLRRRHCQRLDVLCCFSSPCSAQVIQILPQELGDGTVPVGIAHLTATVQAFTHCEASSQHVVTILPPQAHLVPPPSDPLGSELFSPGGSTRDLLGQEEETRQKAACKSLPCARWNLAHFARYQFAPLLLQSHAKAIVLVLFGALLGLSLYGATLVQDGLALTDVVPRGTKEHAFLSAQLRYFSLYEVALVTQGGFDYAHSQRALFDLHQRFSSLKAVLPPPATQAPRTWLHYYRNWLQGIQAAFDQDWASGRITRHSYRNGSEDGALAYKLLIQTGDAQEPLDFSQLTTRKLVDREGLIPPELFYMGLTVWVSSDPLGLAASQANFYPPPPEWLHDKYDTTGENLRIPPAQPLEFAQFPFLLRGLQKTADFVEAIEGARAACAEAGQAGVHAYPSGSPFLFWEQYLGLRRCFLLAVCILLVCTFLVCALLLLNPWTAGLIVLVLAMMTVELFGIMGFLGIKLSAIPVVILVASVGIGVEFTVHVALGFLTTQGSRNLRAAHALEHTFAPVTDGAISTLLGLLMLAGSHFDFIVRYFFAALTVLTLLGLLHGLVLLPVLLSILGPPPEVIQMYKESPEILSPPAPQGGGLRWGASSSLPQSFARVTTSMTVAIHPPPLPGAYIHPAPDEPPWSPAATSSGNLSSRGPGPATG

SEQ ID NO: 207 - protein, 375 aa, Homo sapiens
MDALQLANSAFAVDLFKQLCEKEPLGNVLFSPICLSTSLSLAQVGAKGDTANEIGQVLHFENVKDVPFGFQTVTSDVNKLSSFYSLKLIKRLYVDKSLNLSTEFISSTKRPYAKELETVDFKDKLEETKGQINNSIKDLTDGHFENILADNSVNDQTKILVVNAAYFVGKWMKKFSESETKECPFRVNKTDTKPVQMMNMEATFCMGNIDSINCKIIELPFQNKHLSMFILLPKDVEDESTGLEKIEKQLNSESLSQWTNPSTMANAKVKLSIPKFKVEKMIDPKACLENLGLKHIFSEDTSDFSGMSETKGVALSNVIHKVCLEITEDGGDSIEVPGARILQHKDELNADHPFIYIIRHNKTRNIIFFGKFCSP

SEQ ID NO: 208 - protein, 1754 aa, Homo sapiens
MAPYPCGCHILLLLFCCLAAARANLLNLNWLWFNNEDTSHAATTIPEPQGPLPVQPTADTTTHVTPRNGSTEPATAPGSPEPPSELLEDGQDTPTSAESPDAPEENIAGVGAEILNVAKGIRSFVQLWNDTVPTESLARAETLVLETPVGPLALAGPSSTPQENGTTLWPSRGIPSSPGAHTTEAGTLPAPTPSPPSLGRPWAPLTGPSVPPPSSGRASLSSLLGGAPPWGSLQDPDSQGLSPAAAAPSQQLQRPDVRLRTPLLHPLVMGSLGKHAAPSAFSSGLPGALSQVAVTTLTRDSGAWVSHVANSVGPGLANNSALLGADPEAPAGRCLPLPPSLPVCGHLGISRFWLPNHLHHESGEQVRAGARAWGGLLQTHCHPFLAWFFCLLLVPPCGSVPPPAPPPCCQFCEALQDACWSRLGGGRLPVACASLPTQEDGYCVLIGPAAERISEEVGLLQLLGDPPPQQVTQTDDPDVGLAYVFGPDANSGQVARYHFPSLFFRDFSLLFHIRPATEGPGVLFAITDSAQAMVLLGVKLSGVQDGHQDISLLYTEPGAGQTHTAASFRLPAFVGQWTHLALSVAGGFVALYVDCEEFQRMPLARSSRGLELEPGAGLFVAQAGGADPDKFQGVIAELKVRRDPQVSPMHCLDEEGDDSDGASGDSGSGLGDARELLREETGAALKPRLPAPPPVTTPPLAGGSSTEDSRSEEVEEQTTVASLGAQTLPGSDSVSTWDGSVRTPGGRVKEGGLKGQKGEPGVPGPPGRAGPPGSPCLPGPPGLPCPVSPLGPAGPALQTVPGPQGPPGPPGRDGTPGRDGEPGDPGEDGKPGDTGPQGFPGTPGDVGPKGDKGDPGVGERGPPGPQGPPGPPGPSFRHDKLTFIDMEGSGFGGDLEALRGPRGFPGPPGPPGVPGLPGEPGRFGVNSSDVPGPAGLPGVPGREGPPGFPGLPGPPGPPGREGPPGRTGQKGSLGEAGAPGHKGSKGAPGPAGARGESGLAGAPGPAGPPGPPGPPGPPGPGLPAGFDDMEGSGGPFWSTARSADGPQGPPGLPGLKGDPGVPGLPGAKGEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPPGPRGYPGIPGPKGESIRGQPGPPGPQGPPGIGYEGRQGPPGPPGPPGPPSFPGPHRQTISVPGPPGPPGPPGPPGTMGASSGVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 209 - protein, 155 aa, Homo sapiens
MAEGEITTFTALTEKFNLPPGNYKKPKLLYCSNGGHFLRILPDGTVDGTRDRSDQHIQLQLSAESVGEVYIKSTETGQYLAMDTDGLLYGSQTPNEECLFLERLEENHYNTYISKKHAEKNWFVGLKKNGSCKRGPRTHYGQKAILFLPLPVSSD

SEQ ID NO: 210 - protein, 288 aa, Homo sapiens
MVGVGGGDVEDVTPRPGGCQISGRGARGCNGIPGAAAWEAALPRRRPRRHPSVNPRSRAAGSPRTRGRRTEERPSGSRLGDRGRGRALPGGRLGGRGRGRAPERVGGRGRGRGTAAPRAAPAARGSRPGPAGTMAAGSITTLPALPEDGGSGAFPPGHFKDPKRLYCKNGGFFLRIHPDGRVDGVREKSDPHIKLQLQAEERGVVSIKGVCANRYLAMKEDGRLLASKCVTDECFFFERLESNNYNTYRSRKYTSWYVALKRTGQYKLGSKTGPGQKAILFLPMSAKS

SEQ ID NO: 211 - protein, 239 aa, Homo sapiens
MGLIWLLLLSLLEPGWPAAGPGARLRRDAGGRGGVYEHLGGAPRRRKLYCATKYHLQLHPSGRVNGSLENSAYSILEITAVEVGIVAIRGLFSGRYLAMNKRGRLYASEHYSAECEFVERIHELGYNTYASRLYRTVSSTPGARRQPSAERLWYVSVNGKGRPRRGFKTRRTQKSSLFLPRVLDHRDHEMVRQLQSGLPRPPGKGVQPRRRRQKQSPDNLEPSHVQASRLGSQLEASAH

SEQ ID NO: 212 - protein, 206 aa, Homo sapiens
MSGPGTAAVALLPAVLLALLAPWAGRGGAAAPTAPNGTLEAELERRWESLVALSLARLPVAAQPKEAAVQSGAGDYLLGIKRLRRLYCNVGIGFHLQALPDGRIGGAHADTRDSLLELSPVERGVVSIFGVASRFFVAMSSKGKLYGSPFFTDECTFKEILLPNNYNAYESYKYPGMFIALSKNGKTKKGNRVSPTMKVTHFLPRL

SEQ ID NO: 213 - protein, 268 aa, Homo sapiens
MSLSFLLLLFFSHLILSAWAHGEKRLAPKGQPGPAATDRNPRGSSSRQSSSSAMSSSSASSSPAASLGSQGSGLEQSSFQWSPSGRRTGSLYCRVGIGFHLQIYPDGKVNGSHEANMLSVLEIFAVSQGIVGIRGVFSNKFLAMSKKGKLHASAKFTDDCKFRERFQENSYNTYASAIHRTEKTGREWYVALNKRGKAKRGCSPRVKPQHISTHFLPRFKQSEQPELSFTVTVPEKKKPPSPIKPKIPLSAPRKNTNSVKYRLKFRFG

SEQ ID NO: 214 - protein, 208 aa, Homo sapiens
MALGQKLFITMSRGAGRLQGTLWALVFLGILVGMVVPSPAGTRANNTLLDSRGWGTLLSRSRAGLAGEIAGVNWESGYLVGIKRQRRLYCNVGIGFHLQVLPDGRISGTHEENPYSLLEISTVERGVVSLFGVRSALFVAMNSKGRLYATPSFQEECKFRETLLPNNYNAYESDLYQGTYIALSKYGRVKRGSKVSPIMTVTHFLPRI

SEQ ID NO: 215 - protein, 233 aa, Homo sapiens
MGSPRSALSCLLLHLLVLCLQAQEGPGRGPALGRELASLFRAGREPQGVSQQHVREQSLVTDQLSRRLIRTYQLYSRTSGKHVQVLANKRINAMAEDGDPFAKLIVETDTFGSRVRVRGAETGLYICMNKKGKLIAKSNGKGKDCVFTEIVLENNYTALQNAKYEGWYMAFTRKGRPRKGSKTRQHQREVHFMKRLPRGHHTTEQSLRFEFLNYPPFTRSLRGSQRTWAPEPR

SEQ ID NO: 216 - protein, 208 aa, Homo sapiens
MAPLGEVGNYFGVQDAVPFGNVPVLPVDSPVLLSDHLGQSEAGGLPRGPAVTDLDHLKGILRRRQLYCRTGFHLEIFPNGTIQGTRKDHSRFGILEFISIAVGLVSIRGVDSGLYLGMNEKGELYGSEKLTQECVFREQFEENWYNTYSSNLYKHVDTGRRYYVALNKDGTPREGTRTKRHQKFTHFLPRPVDPDKVPELYKDILSQS

SEQ ID NO: 217 - protein, 243 aa, Homo sapiens
MAAAIASSLIRQKRQARESNSDRVSASKRRSSPSKDGRSLCERHVLGVFSKVRFCSGRKRPVRRRPEPQLKGIVTRLFSQQGYFLQMHPDGTIDGTKDENSDYTLFNLIPVGLRVVAIQGVKASLYVAMNGEGYLYSSDVFTPECKFKESVFENYYVIYSSTLYRQQESGRAWFLGLNKEGQIMKGNRVKKTKPSSHFVPKPIEVCMYREPSLHEIGEKQGRSRKSSGTPTMNGGKVVNQDST

SEQ ID NO: 218 - protein, 216 aa, Homo sapiens
MRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 219 - protein, 207 aa, Homo sapiens
MAEVGGVFASLDWDLHGFSSSLGNVPLADSPGFLNERLGQIEGKLQRGSPTDFAHLKGILRRRQLYCRTGFHLEIFPNGTVHGTRHDHSRFGILEFISLAVGLISIRGVDSGLYLGMNERGELYGSKKLTRECVFREQFEENWYNTYASTLYKHSDSERQYYVALNKDGSPREGYRTKRHQKFTHFLPRPVDPSKLPSMSRDLFHYR

SEQ ID NO: 220 - protein, 207 aa, Homo sapiens
MYSAPSACTCLCLHFLLLCFQVQVLVAEENVDFRIHVENQTRARDDVSRKQLRLYQLYSRTSGKHIQVLGRRISARGEDGDKYAQLLVETDTFGSQVRIKGKETEFYLCMNRKGKLVGKPDGTSKECVFIEKVLENNYTALMSAKYSGWYVGFTKKGRPRKGPKTRENQQDVHFMKRYPKGQPELQKPFKYTTVTKRSRRIRPTHPA

SEQ ID NO: 221 - protein, 235 aa, Homo sapiens
MTVLAPAWSPTTYLLLLLLLSSGLSGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 222 - protein, 110 aa, Homo sapiens
APMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDR

SEQ ID NO: 223 - protein, 147 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKCDKPRR

SEQ ID NO: 224 - protein, 145 aa, Homo sapiens
APMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVCDKPRR

SEQ ID NO: 225 - protein, 191 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 226 - protein, 215 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVPCGPCSERRKHLFVQDPQTCKCSCKNTDSRCKARQLELNERTCRCDKPRR

SEQ ID NO: 227 - protein, 232 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVYVGARCCLMPWSLPGPHPCGPCSERRKHLFVQDPQTCKCSCKNTDSRCKARQLELNERTCRCDKPRR

SEQ ID NO: 228 - protein, 345 aa, Homo sapiens
MSLFGLLLLTSALAGQRQGTQAESNLSSKFQFSSNKEQNGVQDPQHERIITVSTNGSIHSPRFPHTYPRNTVLVWRLVAVEENVWIQLTFDERFGLEDPEDDICKYDFVEVEEPSDGTILGRWCGSGTVPGKQISKGNQIRIRFVSDEYFPSEPGFCIHYNIVMPQFTEAVSPSVLPPSALPLDLLNNAITAFSTLEDLIRYLEPERWQLDLEDLYRPTWQLLGKAFVFGRKSRVVDLNLLTEEVRLYSCTPRNFSVSIREELKRTDTIFWPGCLLVKRCGGNCACCLHNCNECQCVPSKVTKKYHEVLQLRPKTGVRGLHKSLTDVALEHHEECDCVCRGSTGG

SEQ ID NO: 229 - protein, 1356 aa, Homo sapiens
MQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSGIVLKDGNRNLTIRRVRKEDEGLYTCQACSVLGCAKVEAFFIIEGAQEKTNLEIIILVGTAVIAMFFWLLLVIILRTVKRANGGELKTGYLSIVMDPDELPLDEHCERLPYDASKWEFPRDRLKLGKPLGRGAFGQVIEADAFGIDKTATCRTVAVKMLKEGATHSEHRALMSELKILIHIGHHLNVVNLLGACTKPGGPLMVIVEFCKFGNLSTYLRSKRNEFVPYKTKGARFRQGKDYVGAIPVDLKRRLDSITSSQSSASSGFVEEKSLSDVEEEEAPEDLYKDFLTLEHLICYSFQVAKGMEFLASRKCIHRDLAARNILLSEKNVVKICDFGLARDIYKDPDYVRKGDARLPLKWMAPETIFDRVYTIQSDVWSFGVLLWEIFSLGASPYPGVKIDEEFCRRLKEGTRMRAPDYTTPEMYQTMLDCWHGEPSQRPTFSELVEHLGNLLQANAQQDGKDYIVLPISETLSMEEDSGLSLPTSPVSCMEEEEVCDPKFHYDNTAGISQYLQNSKRKSRPVSVKTFEDIPLEEPEVKVIPDDNQTDSGMVLASEELKTLEDRTKLSPSFGGMVPSKSRESVASEGSNQTSGYQSGYHSDDTDTTVYSSEEAELLKLIEIGVQTGSTAQILQPDSGTTLSSPPV

SEQ ID NO: 230 - protein, 1338 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLELITLTCTCVAATLFWLLLTLFIRKMKRSSSEIKTDYLSIIMDPDEVPLDEQCERLPYDASKWEFARERLKLGKSLGRGAFGKVVQASAFGIKKSPTCRTVAVKMLKEGATASEYKALMTELKILTHIGHHLNVVNLLGACTKQGGPLMVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 231 - protein, 1363 aa, Homo sapiens
MQRGAALCLRLWLCLGLLDGLVSGYSMTPPTLNITEESHVIDTGDSLSISCRGQHPLEWAWPGAQEAPATGDKDSEDTGVVRDCEGTDARPYCKVLLLHEVHANDTGSYVCYYKYIKARIEGTTAASSYVFVRDFEQPFINKPDTLLVNRKDAMWVPCLVSIPGLNVTLRSQSSVLWPDGQEVVWDDRRGMLVSTPLLHDALYLQCETTWGDQDFLSNPFLVHITGNELYDIQLLPRKSLELLVGEKLVLNCTVWAEFNSGVTFDWDYPGKQAERGKWVPERRSQQTHTELSSILTIHNVSQHDLGSYVCKANNGIQRFRESTEVIVHENPFISVEWLKGPILEATAGDELVKLPVKLAAYPPPEFQWYKDGKALSGRHSPHALVLKEVTEASTGTYTLALWNSAAGLRRNISLELVVNVPPQIHEKEASSPSIYSRHSRQALTCTAYGVPLPLSIQWHWRPWTPCKMFAQRSLRRRQQQDLMPQCRDWRAVTTQDAVNPIESLDTWTEFVEGKNKTVSKLVIQNANVSAMYKCVVSNKVGQDERLIYFYVTTIPDGFTIESKPSEELLEGQPVLLSCQADSYKYEHLRWYRLNLSTLHDAHGNPLLLDCKNVHLFATPLAASLEEVAPGARHATLSLSIPRVAPEHEGHYVCEVQDRRSHDKHCHKKYLSVQALEAPRLTQNLTDLLVNVSDSLEMQCLVAGAHAPSIVWYKDERLLEEKSGVDLADSNQKLSIQRVREEDAGRYLCSVCNAKGCVNSSASVAVEGSEDKGSMEIVILVGTGVIAVFFWVLLLLIFCNMRRPAHADIKTGYLSIIMDPGEVPLEEQCEYLSYDASQWEFPRERLHLGRVLGYGAFGKVVEASAFGIHKGSSCDTVAVKMLKEGATASEHRALMSELKILIHIGNHLNVVNLLGACTKPQGPLMVIVEFCKYGNLSNFLRAKRDAFSPCAEKSPEQRGRFRAMVELARLDRRRPGSSDRVLFARFSKTEGGARRASPDQEAEDLWLSPLTMEDLVCYSFQVARGMEFLASRKCIHRDLAARNILLSESDVVKICDFGLARDIYKDPDYVRKGSARLPLKWMAPESIFDKVYTTQSDVWSFGVLLWEIFSLGASPYPGVQINEEFCQRLRDGTRMRAPELATPAIRRIMLNCWSGDPKARPAFSELVEILGDLLQGRGLQEEEEVCMAPRSSQSSEEGSFSQVSTMALHIAQADAEDSPPSLQRHSLAARYYNWVSFPGCLARGAETRGSSRMKTFEEFPMTPTTYKGSVDNQTDSGMVLASEEFEQIESRHRQESGFSCKGPGQNVAVTRAHPDSQGRRRRPERGARGGQVFYNSEYGELSEPSEEDHCSPSARVTFFTDNSY

SEQ ID NO: 232 - protein, 923 aa, Homo sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFVPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGDDFQLTGGTTVLATEKPTVIDSTIQSEFPTYGFNCEFGWGSHKTFCHWEHDNHVQLKWSVLTSKTGPIQDHTGDGNFIYSQADENQKGKVARLVSPVVYSQNSAHCMTFWYHMSGSHVGTLRVKLRYQKPEEYDQLVWMAIGHQGDHWKEGRVLLHKSLKLYQVIFEGEIGKGNLGGIAVDDISINNHISQEDCAKPADLDKKNPEIKIDETGSTPGYEGEGEGDKNISRKPGNVLKTLDPILITIIAMSALGVLLGAVCGVVLYCACWHNGMSERNLSALENYNFELVDGVKLKKDKLNTQSTYSEA

SEQ ID NO: 233 - protein, 931 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIRFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAGENFKVDIPEIHEREGYEDEIDDEYEVDWSNSSSATSGSGAPSTDKEKSWLYTLDPILITIIAMSSLGVLLGATCAGLLLYCTCSYSGLSSRSCTTLENYNFELYDGLKHKVKMNHQKCCSEA

SEQ ID NO: 234 - protein, 160 aa, Homo sapiens
MTDQQAEARSYLSEEMIAEFKAAFDMFDADGGGDISVKELGTVMRMLGQTPTKEELDAIIEEVDEDGSGTIDFEEFLVMMVRQMKEDAKGKSEEELAECFRIFDRNADGYIDPEELAEIFRASGEHVTDEEIESLMKDGDKNNDGRIDFDEFLKMMEGVQ

SEQ ID NO: 235 - protein, 182 aa, Homo sapiens
MGDEEKRNRAITARRQHLKSVMLQIAATELEKEESRREAEKQNYLAEHCPPLHIPGSMSEVQELCKQLHAKIDAAEEEKYDMEVRVQKTSKELEDMNQKLFDLRGKFKRPPLRRVRMSADAMLKALLGSKHKVCMDLRANLKQVKKEDTEKERDLRDVGDWRKNIEEKSGMEGRKKMFESES

SEQ ID NO: 236 - protein, 258 aa, Homo sapiens
MSDEEVEQVEEQYEEEEEAQEEEEVQEDTAEEDAEEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDITTLRSRIDQAQKHSKKAGTPAKGKVGGRWK

SEQ ID NO: 237 - protein, 153 aa, Homo sapiens
  MISC_FEATURE (79)..(79): S-carboxyamidomethylcysteine
  MISC_FEATURE (96)..(96): S-carboxyamidomethylcysteine
ADGSSDAAREPRPAPAPIRRRSSNYRAYATEPHAKKKSKISASRKLQLKTLLLQIAKQELEREAEERRGEKGRALSTRCQPLELTGLGFAELQDLCRQLHARVDKVDEERYDIEAKVTKNITEIADLTQKIFDLRGKFKRPTLRRVRISADAM

SEQ ID NO: 238 - protein, 402 aa, Homo sapiens [sequence omitted]

SEQ ID NO: 239 - protein, 415 aa, Homo sapiens
MEDLCVANTLFALNLFKHLAKASPTQNLFLSPWSISSTMAMVYMGSRGSTEDQMAKVLQFNEVGANAVTPMTPENFTSCGFMQQIQKGSYPDAILQAQAADKIHSSFRSLSSAINASTGNYLLESVNKLFGEKSASFREEYIRLCQKYYSSEPQAVDFLECAEEARKKINSWVKTQTKGKIPNLLPEGSVDGDTRMVLVNAVYFKGKWKTPFEKKLNGLYPFRVNSAQRTPVQMMYLREKLNIGYIEDLKAQILELPYAGDVSMFLLLPDEIADVSTGLELLESEITYDKLNKWTSKDKMAEDEVEVYIPQFKLEEHYELRSILRSMGMEDAFNKGRANFSGMSERNDLFLSEVFHQAMVDVNEEGTEAAAGTGGVMTGRTGHGGPQFVADHPFLFLIMHKITNCILFFGRFSSP

SEQ ID NO: 240 - protein, 368 aa, Homo sapiens
MVLEVSDHQVLNDAEVAALLENFSSSYDYGENESDSCCTSPPCPQDFSLNFDRAFLPALYSLLFLLGLLGNGAVAAVLLSRRTALSSTDTFLLHLAVADTLLVLTLPLWAVDAAVQWVFGSGLCKVAGALFNINFYAGALLLACISFDRYLNIVHATQLYRRGPPARVTLTCLAVWGLCLLFALPDFIFLSAHHDERLNATHCQYNFPQVGRTALRVLQLVAGFLLPLLVMAYCYAHILAVLLVSRGQRRLRAMRLVVVVVVAFALCWTPYHLVVLVDILMDLGALARNCGRESRVDVAKSVTSGLGYMHCCLNPLLYAFVGVKFRERMWMLLLRLGCPNQRGLQRQPSSSRRDSSWSETSEASYSGL

SEQ ID NO: 241 - protein, 91 aa, Homo sapiens
MKVSAAALAVILIATALCAPASASPYSSDTTPCCFAYIARPLPRAHIKEYFYTSGKCSNPAVVFVTRKNRQVCANPEKKWVREYINSLEMS

SEQ ID NO: 242 - protein, 98 aa, Homo sapiens
MNQTAILICCLIFLTLSGIQGVPLSRTVRCTCISISNQPVNPRSLEKLEIIPASQFCPRVEIIATMKKKGEKRCLNPESKAIKNLLKAVSKERSKRSP

SEQ ID NO: 243 - protein, 378 aa, Homo sapiens
MDLGKPMKSVLVVALLVIFQVCLCQDEVTDDYIGDNTTVDYTLFESLCSKKDVRNFKAWFLPIMYSIICFVGLLGNGLVVLTYIYFKRLKTMTDTYLLNLAVADILFLLTLPFWAYSAAKSWVFGVHFCKLIFAIYKMSFFSGMLLLLCISIDRYVAIVQAVSAHRHRARVLLISKLSCVGIWILATVLSIPELLYSDLQRSSSEQAMRCSLITEHVEAFITIQVAQMVIGFLVPLLAMSFCYLVIIRTLLQARNFERNKAIKVIIAVVVVFIVFQLPYNGVVLAQTVANFNITSSTCELSKQLNIAYDVTYSLACVRCCVNPFLYAFIGVKFRNDLFKLFKDLGCLSQEQLRQWSSCRHIRRSSMSVEAETTTTFSP

SEQ ID NO: 244 - protein, 397 aa, Homo sapiens
MAPISLSWLLRLATFCHLTVLLAGQHHGVTKCNITCSKMTSKIPVALLIHYQQNQASCGKRAIILETRQHRLFCADPKEQWVKDAMQHLDRQAAALTRNGGTFEKQIGEVKPRTTPAAGGMDESVVLEPEATGESSSLEPTPSSQEAQRALGTSPELPTGVTGSSGTRLPPTPKAQDGGPVGTELFRVPPVSTAATWQSSAPHQPGPSLWAEAKTSEAPSTQDPSTQASTASSPAPEENAPSEGQRVWGQGQSPRPENSLEREEMGPVPAHTDAFQDWGPGSMAHVSVVPVSSEGTPSREPVASGSWTPKAEEPIHATMDPQRLGVLITPVPDAQAATRRQAVGLLAFLGLLFCLGVAMFTYQSLQGCPRKMAGEMAEGLRYIPRSCGSNSYVLVPV

SEQ ID NO: 245 - protein, 97 aa, Homo sapiens
MKVSAALLWLLLIAAAFSPQGLAGPASVPTTCCFNLANRKIPLQRLESYRRITSGKCPQKAVIFKTKLAKDICADPKKKWVQDSMKYLDQKSPTPKP

SEQ ID NO: 246 - protein, 134 aa, Homo sapiens
MAQSLALSLLILVLAFGIPRTQGSDGGAQDCCLKYSQRKIPAKVVRSYRKQEPSLGCSIPAILFLPRKRSQAELCADPKELWVQQLMQHLDKTPSPQKPAQGCRKDRGASKTGKKGKGSKGCKRTERSQTPKGP

SEQ ID NO: 247 - protein, 114 aa, Homo sapiens
MRLLILALLGICSLTAYIVEGVGSEVSDKRTCVSLTTQRLPVSRIKTYTITEGSLRAVIFITKRGLKVCADPQATWVRDVVRSMDRKSNTRNNMIQTKPTGTQQSTNTAVTLTG

SEQ ID NO: 248 - protein, 96 aa, Homo sapiens
MCCTKSLLLAALMSVLLLHLCGESEAASNFDCCLGYTDRILHPKFIVGFTRQLANEGCDINAIIFHTKKKLSVCANPKQTWVKYIVRLLSKKVKNM

SEQ ID NO: 249 - protein, 98 aa, Homo sapiens
MALLLALSLLVLWTSPAPTLSGTNDAEDCCLSVTQKPIPGYIVRNFHYLLIKDGCRVPAVVFTTLRGRQLCAPPDQPWVERIIQRLQRTSAKMKRRSS

SEQ ID NO: 250 - protein, 353 aa, Homo sapiens
MELTELLLVVMLLLTARLTLSSPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVRRAPPTTAVPSRTSLVLTLNELPNRTSGLLETNFTASARTTGSGLLKWQQGFRAKIPGLLNQTSRSLDQIPGYLNRIHELLNGTRGLFPGPSRRTLGAPDISSGTSDTGSLPPNLQPGYSPSPTHPPTGQYTLFPLPPTLPTPVVQLHPLLPDPSAPTPTPTSPLLNTSYTHSQNLSQEG

SEQ ID NO: 251 - protein, 273 aa, Homo sapiens
MKKTQTWILTCIYLQLLLFNPLVKTEGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 252 - protein, 149 aa, Homo sapiens
MPVMRLFPCFLQLLAGLALPAVPPQQWALSAGNGSSEVEVVPFQEVWGRSYCRALERLVDVVSEYPSEVEHMFSPSCVSLLRCTGCCGDENLHCVPVETANVTMQLLKIRSGDRPSYVELTFSQHVRCECRPLREKMKPERCGDAVPRR

SEQ ID NO: 253 - protein, 170 aa, Homo sapiens
MPVMRLFPCFLQLLAGLALPAVPPQQWALSAGNGSSEVEVVPFQEVWGRSYCRALERLVDVVSEYPSEVEHMFSPSCVSLLRCTGCCGDENLHCVPVETANVTMQLLKIRSGDRPSYVELTFSQHVRCECRPLREKMKPERRRPKGRGKRRREKQRPTDCHLCGDAVPRR

SEQ ID NO: 254 - protein, 241 aa, Homo sapiens
MSMLFYTLITAFLIGIQAEPHSESNVPAGHTIPQAHWTKLQHSLDTALRRARSAPAAAIAARVAGQTRNITVDPRLFKKRRLRSPRVLFSTQPPREAADTQDLDFEVGGAAPFNRTHRSKRSSSHPIFHRGEFSVCDSVSVWVGDKTTATDIKGKEVMVLGEVNINNSVFKQYFFETKCRDPNPVDSGCRGIDSKHWNSYCTTTHTFVKALTMDGKQAAWRFIRIDTACVCVLSRKAVRRA

SEQ ID NO: 255 - protein, 257 aa, Homo sapiens
MSILFYVIFLAYLRGIQGNNMDQRSLPEDSLNSLIIKLIQADILKNKLSKQMVDVKENYQSTLPKAEAPREPERGGPAKSAFQPVIAMDTELLRQQRRYNSPRVLLSDSTPLEPPPLYLMEDYVGSPVVANRTSRRKRYAEHKSHRGEYSVCDSESLWVTDKSSAIDIRGHQVTVLGEIKTGNSPVKQYFYETRCKEARPVKNGCRGIDDKHWNSQCKTSQTYVRALTSENNKLVGWRWIRIDTSCVCALSRKIGRT

SEQ ID NO: 256 - protein, 210 aa, Homo sapiens
MLPLPSCSLPILLLFLLPSVPIESQPPPSTLPPFLAPEWDLLSPRVVLSRGAPAGPPLLFLLEAGAFRESAGAPANRSRRGVSETAPASRRGELAVCDAVSGWVTDRRTAVDLRGREVEVLGEVPAAGGSPLRQYFFETRCKADNAEEGGPGAGGGGCRGVDRRHWVSECKAKQSYVRALTADAQGRVGWRWIRIDTACVCTLLSRTGRA

SEQ ID NO: 257 - protein, 211 aa, Homo sapiens [sequence omitted]

SEQ ID NO: 258 - protein, 241 aa, Homo sapiens
MNRCWALFLSLCCYLRLVSAEGDPIPEELYEMLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVTRSPGGSQEQRAKTPQTRVTIRTVRVRRPPKGKHRKFKHTHDKTALKETLGA

SEQ ID NO: 259 - protein, 89 aa, Homo sapiens
MNAKVVVVLVLVLTALCLSDGKPVSLSYRCPCRFFESHVARANVKHLKILNTPNCALQIVARLKNNNRQVCIDPKLKWIQEYLEKALNK

SEQ ID NO: 260 - protein, 93 aa, Homo sapiens
MNAKVVVVLVLVLTALCLSDGKPVSLSYRCPCRFFESHVARANVKHLKILNTPNCALQIVARLKNNNRQVCIDPKLKWIQEYLEKALNKRFKM

SEQ ID NO: 261 - protein, 94 aa, Homo sapiens
MAPLKMLALVTLLLGASLQHIHAARGTNVGRECCLEYFKGAIPLRKLKTWYQTSEDCSRDAIVFVTVQGRAICSDPNNKRVKNAVKYLQSLERS

SEQ ID NO: 262 - protein, 227 aa, Homo sapiens
MNIKGSPWKGSLLLLLVSNLLLCQSVAPLPICPGGAARCQVTLRDLFDRAVVLSHYIHNLSSEMFSEFDKRYTHGRGFITKAINSCHTSSLATPEDKEQAQQMNQKDFLSLIVSILRSWNEPLYHLVTEVRGMQEAPEAILSKAVEIEEQTKRLLEGMELIVSQVHPETKENEIYPVWSGLPSLQMADEESRLSAYYNLLHCLRRDSHKIDNYLKLLKCRIIHNNNC

SEQ ID NO: 263 - protein, 116 aa, Homo sapiens
MDYYRKYAAIFLVTLSVFLHVLHSAPDVQDCPECTLQENPFFSQPGAPILQCMGCCFSRAYPTPLRSKKTMLVQKNVTSESTCCVAKSYNRVTVMGGFKVENHTACHCSTCYYHKS

SEQ ID NO: 264 - protein, 129 aa, Homo sapiens
MKTLQFFFLFCCWKAICCNSCELTNITIAIEKEECRFCISINTTWCAGYCYTRDLVYKDPARPKIQKTCTFKELVYETVRVPGCAHHADSLYTYPVATQCHCGKCDSDSTDCTVRGLGPSYCSFGEMKE

SEQ ID NO: 265 - protein, 125 aa, Homo sapiens
MAGPSLACCLLGLLALTSACYIQNCPLGGKRAAPDLDVRKCLPCGPGGKGRCFGPNICCAEELGCFVGTAEALRCQEENYLPSPCQSGQKACGSGGRCAVLGLCCSPDGCHADPACDAEATFSQR

SEQ ID NO: 266 - protein, 164 aa, Homo sapiens
MPDTMLPACFLGLLAFSSACYFQNCPRGGKRAMSDLELRQCLPCGPGGKGRCFGPSICCADELGCFVGTAEALRCQEENYLPSPCQSGQKACGSGGRCAAFGVCCNDESCVTEPECREGFHRRARASDRSNATQLDGPAGALLLRLVQLAGAPEPFEPAQPDAY

SEQ ID NO: 267 - protein, 269 aa, Homo sapiens
MAEVPELASEMMAYYSGNEDDLFFEADGPKQMKCSFQDLDLCPLDGGIQLRISDHHYSKGFRQAASVVVAMDKLRKMLVPCPQTFQENDLSTFFPFIFEEEPIFFDTWDNEAYVHDAPVRSLNCTLRDSQQKSLVMSGPYELKALHLQGQDMEQQVVFSMSFVQGEESNDKIPVALGLKEKNLYLSCVLKDDKPTLQLESVDPKNYPKKKMEKRFVFNKIEINNKLEFESAQFPNWYISTSQAENMPVFLGGTKGGQDITDFTMQFVSS

SEQ ID NO: 268 - protein, 153 aa, Homo sapiens [sequence omitted]

SEQ ID NO: 269 - protein, 271 aa, Homo sapiens
MAKVPDMFEDLKNCYSENEEDSSSIDHLSLNQKSFYHVSYGPLHEGCMDQSVSLSISETSKTSKLTFKESMVVVATNGKVLKKRRLSLSQSITDDDLEAIANDSEEEIIKPRSAPFSFLSNVKYNFMRIIKYEFILNDALNQSIIRANDQYLTAAALHNLDEAVKFDMGAYKSSKDDAKITVILRISKTQLYVTAQDEDQPVLLKEMPEIPKTITGSETNLLFFWETHGTKNYFTSVAHPNLFIATKQDYWVCLAGGPPSITDFQILENQA

SEQ ID NO: 270 - protein, 212 aa, Homo sapiens
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 271 - protein, 146 aa, Homo sapiens [sequence omitted]

SEQ ID NO: 272 - protein, 178 aa, Homo sapiens
MHSSALLCCLVLLTGVRASPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 273 - protein, 160 aa, Homo sapiens
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 274 - protein, 269 aa, Homo sapiens; identical to SEQ ID NO: 267

SEQ ID NO: 275 - protein, 350 aa, Homo sapiens [sequence omitted]

SEQ ID NO: 276 - protein, 177 aa, Homo sapiens
MFHVSFRYIFGLPPLILVLLPVASSDCDIEGKDGKQYESVLMVSIDQLLDSMKEIGSNCLNNEFNFFKRHICDANKEGMFLFRAARKLRQFLKMNSTGDFDLHLLKVSEGTTILLNCTGQVKGRKPAALGEAQPTKSLEENKSLKEQKKLNDLCFLKRLLQEIKTCWNKILMGTKEH

SEQ ID NO: 277 - protein, 328 aa, Homo sapiens
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 278 - protein, 470 aa, Homo sapiens
MGKPWLRALQLLLLLGASWARAGAPRCTYTFVLPPQKFTGAVCWSGPASTRATPEAANASELAALRMRVGRHEELLRELQRLAAADGAVAGEVRALRKESRGLSARLGQLRAQLQHEAGPGAGPGADLGAEPAAALALLGERVLNASAEAQRAAARFHQLDVKFRELAQLVTQQSSLIARLERLCPGGAGGQQQVLPPPPLVPVVPVRLVGSTSDTSRMLDPAPEPQRDQTQRQQEPMASPMPAGHPAVPTKPVGPWQDCAEARQAGHEQSGVYELRVGRHVVSVWCEQQLEGGGWTVIQRRQDGSVNFFTTWQHYKAGFGRPDGEYWLGLEPVYQLTSRGDHELLVLLEDWGGRGARAHYDGFSLEPESDHYRLRLGQYHGDAGDSLSWHNDKPFSTVDRDRDSYSGNCALYQRGGWWYHACAHSNLNGVWHHGGHYRSRYQDGVYWAEFRGGAYSLRKAAMLIRPLKL

SEQ ID NO: 279 - protein, 144 aa, Homo sapiens
MLLAMVLTSALLLCSVAGQGCPTLAGILDINFLINKMQEDPASKCHCSANVTSCLCLGIPSDNCTRPCFSERLSQMTNTTMQTRYPLIFSRVKKSVEVLKNNKCPYFSCEQPCNQTTAGNALTFLKSLLEIFQKEKMRGMRGKI

SEQ ID NO: 280 - protein, 152 aa, Homo sapiens
MSRLPVLLLLQLLVRPGLQAPMTQTTPLKTSWVNCSNMIDEIITHLKQPPLPLLDFNNLNGEDQDILMENNLRRPNLEAFNRAVKSLQNASAIESILKNLLPCLPLATAAPTRHPIHIKDGDWNEFRRKLTFYLKTLENAQAQQTTLSLAIF

SEQ ID NO: 281 - protein, 134 aa, Homo sapiens
MRMLLHLSLLALGAAYVYAIPTEIPTSALVKETLALLSTHRTLLIANETLRIPVPVHKNHQLCTEEIFQGIGTLESQTVQGGTVERLFKNLSLIKKYIDGQKKKCGEERRRVNQFLDYLQEFLGVMNTEWIIES

SEQ ID NO: 282 - protein, 1332 aa, Homo sapiens
MESHSRAGKSRKSAKFRSISRSLMLCNAKTSDDGSSPDEKYPDPFEISLAQGKEGIFHSSVQLADTSEAGPSSVPDLALASEAAQLQAAGNDRGKTCRRIFFMKESSTASSREKPGKLEAQSSNFLFPKACHQRARSNSTSVNPYCTREIDFPMTKKSAAPTDRQPYSLCSNRKSLSQQLDCPAGKAAGTSRPTRSLSTAQLVQPSGGLQASVISNIVLMKGQAKGLGFSIVGGKDSIYGPIGIYVKTIFAGGAAAADGRLQEGDEILELNGESMAGLTHQDALQKFKQAKKGLLTLTVRTRLTAPPSLCSHLSPPLCRSLSSSTCITKDSSSFALESPSAPISTAKPNYRIMVEVSLQKEAGVGLGIGLCSVPYFQCISGIFVHTLSPGSVAHLDGRLRCGDEIVEISDSPVHCLTLNEVYTILSHCDPGPVPIIVSRHPDPQVSEQQLKEAVAQAVENTKFGKERHQWSLEGVKRLESSWHGRPTLEKEREKNSAPPHRRAQKVMIRSSSDSSYMSGSPGGSPGSGSAEKPSSDVDISTHSPSLPLAREPVVLSIASSRLPQESPPLPESRDSHPPLRLKKSFEILVRKPMSSKPKPPPRKYFKSDSDPQKSLEERENSSCSSGHTPPTCGQEARELLPLLLPQEDTAGRSPSASAGCPGPGIGPQTKSSTEGEPGWRRASPVTQTSPIKHPLLKRQARMDYSFDTTAEDPWVRISDCIKNLFSPIMSENHGHMPLQPNASLNEEEGTQGHPDGTPPKLDTANGTPKVYKSADSSTVKKGPPVAPKPAWFRQSLKGLRNRASDPRGLPDPALSTQPAPASREHLGSHIRASSSSSSIRQRISSFETFGSSQLPDKGAQRLSLQPSSGEAAKPLGKHEEGRFSGLLGRGAAPTLVPQQPEQVLSSGSPAASEARDPGVSESPPPGRQPNQKTLPPGPDPLLRLLSTQAEESQGPVLKMPSQRARSFPLTRSQSCETKLLDEKTSKLYSISSQVSSAVMKSLLCLPSSISCAQTPCIPKEGASPTSSSNEDSAANGSAETSALDTGFSLNLSELREYTEGLTEAKEDDDGDHSSLQSGQSVISLLSSEELKKLIEEVKVLDEATLKQLDGIHVTILHKEEGAGLGFSLAGGADLENKVITVHRVFPNGLASQEGTIQKGNEVLSINGKSLKGTTHHDALAILRQAREPRQAVIVTRKLTPEAMPDLNSSTDSAASASAASDVSVESTAEATVCTVTLEKMSAGLGFSLEGGKGSLHGDKPLTINRIFKGAASEQSETVQPGDEILQLGGTAMQGLTRFEAWNIIKALPDGPVTIVIRRKSLQSKETTAAGDS

SEQ ID NO: 283 - protein, 193 aa, Homo sapiens
MAAEPVEDNCINFVAMKFIDNTLYFIAEDDENLESDYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 284 - protein, 219 aa, Homo sapiens
MCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 285 - protein, 162 aa, Homo sapiens
MRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 286 - protein, 153 aa, Homo sapiens [sequence omitted]

SEQ ID NO: 287 - protein, 154 aa, Homo sapiens
MVLSGALCFRMKDSALKVLYLHNNQLLAGGLHAGKVIKGEEISWPNRWLDASLSPVILGVQGGSQCLSCGVGQEPTLTLEPVNIMELYLGAKESKSFTFYRRDMGLTSSFESAAYPGWFLCTVPEADQPVRLTQLPENGGWNAPITDFYFQQCD

SEQ ID NO: 288 - protein, 199 aa, Homo sapiens
MNCVCRLVLVVLSLWPDTAVAPGPPPGPPRVSPDPRAELDSTVLLTRSLLADTRQLAAQLRDKFPADGDHNLDSLPTLAMSAGALGALQLPGVLTRLRADLLSYLRHVQWLRRAGGSSLKTLEPELGTLQARLDRLLRRLQLLMSRLALPQPPPDPPAPPLAPPSSAWGGIRAAHAILGGLHLTLDWAVRGLLLLKTRL

SEQ ID NO: 289 - protein, 546 aa, Homo sapiens
MKNQDKKNGAAKQSNPKSSPGQPEAGPEGAQERPSQAAPAVEAEGPGSSQAPRKPEGAQARTAQSGALRDVSEELSRQLEDILSTYCVDNNQGGPGEDGAQGEPAEPEDAEKSRTYVARNGEPEPTPVVNGEKEPSKGDPNTEEIRQSDEVGDRDHRRPQEKKKAKGLGKEITLLMQTLNTLSTPEEKLAALCKKYAELLEEHRNSQKQMKLLQKKQSQLVQEKDHLRGEHSKAVLARSKLESLCRELQRHNRSLKEEGVQRAREEEEKRKEVTSHFQVTLNDIQLQMEQHNERNSKLRQENMELAERLKKLIEQYELREEHIDKVFKHKDLQQQLVDAKLQQAQEMLKEAEERHQREKDFLLKEAVESQRMCELMKQQETHLKQQLALYTEKFEEFQNTLSKSSEVFTTFKQEMEKMTKKIKKLEKETTMYRSRWESSNKALLEMAEEKTVRDKELEGLQVKIQRLEKLCRALQTERNDLNKRVQDLSAGGQGSLTDSGPERRPEGPGAQAPSSPRVTEAPCYPGAPSTEASGQTGPQEPTSARA

SEQ ID NO: 290 - protein, 866 aa, Homo sapiens
MGAARSPPSAVPGPLLGLLLLLLGVLAPGGASLRLLDHRALVCSQPGLNCTVKNSTCLDDSWIHPRNLTPSSPKDLQIQLHFAHTQQGDLFPVAHIEWTLQTDASILYLEGAELSVLQLNTNERLCVRFEFLSKLRHHHRRWRFTFSHFVVDPDQEYEVTVHHLPKPIPDGDPNHQSKNFLVPDCEHARMKVTTPCMSSGSLWDPNITVETLEAHQLRVSFTLWNESTHYQILLTSFPHMENHSCFEHMHHIPAPRPEEFHQRSNVTLTLRNLKGCCRHQVQIQPFFSSCLNDCLRHSATVSCPEMPDTPEPIPDYMPLWVYWFITGISILLVGSVILLIVCMTWRLAGPGSEKYSDDTKYTDGLPAADLIPPPLKPRKVWIIYSADHPLYVDVVLKFAQFLLTACGTEVALDLLEEQAISEAGVMTWVGRQKQEMVESNSKIIVLCSRGTRAKWQALLGRGAPVRLRCDHGKPVGDLFTAAMNMILPDFKRPACFGTYVVCYFSEVSCDGDVPDLFGAAPRYPLMDRFEEVYFRIQDLEMFQPGRMHRVGELSGDNYLRSPGGRQLRAALDRFRDWQVRCPDWFECENLYSADDQDAPSLDEEVFEEPLLPPGTGIVKRAPLVREPGSQACLAIDPLVGEEGGAAVAKLEPHLQPRGQPAPQPLHTLVLAAEEGALVAAVEPGPLADGAAVRLALAGEGEACPLLGSPGAGRNSVLFLPVDPEDSPLGSSTPMASPDLLPEDVREHLEGLMLSLFEQSLSCQAQGGCSRPAMVLTDPHTPYEEEQRQSVQSDQGYISRSSPQPPEGLTEMEEEEEEEQDPGKPALPLSPEDLESLRSLQRQLLFRQLQKNSGWDTMGSESEGPSA

SEQ ID NO: 291 - protein, 155 aa, Homo sapiens
MTPGKTSLVSLLLLLSLEAIVKAGITIPRNPGCPNSEDKNFPRTVMVNLNIHNRNTNTNPKRSSDYYNRSTSPWNLHRNEDPERYPSVIWEAKCRHLGCINADGNVDYHMNSVPIQQEILVLRREPPHCPNSFRLEKILVSVGCTCVTPIVHHVA

SEQ ID NO: 292 - protein, 177 aa, Homo sapiens
MKLQCVSLWLLGTILILCSVDNHGLRRCLISTDMHHIEESFQEIKRAIQAKDTFPNVTILSTLETLQIIKPLDVCCVTKNLLAFYVDRVFKDHQEPNPKILRKISSIANSFLYMQKTLRQCQEQRQCHCRQEATNATRVIHDNYDQLEVHAAAIKSLGELDVFLAWINKNHEVMFSA

SEQ ID NO: 293 - protein, 155 aa, Homo sapiens
MERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 294 - protein, 350 aa, Homo sapiens
MSNITDPQMWDFDDLNFTGMPPADEDYSPCMLETETLNKYVVIIAYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRHLVKFVCLGCWGLSMNLSLPFFLFRQAYHPNNSSPVCYEVLGNDTAKWRMVLRILPHTFGFIVPLFVMLFCYGFTLRTLFKAHMGQKHRAMRVIFAVVLIFLLCWLPYNLVLLADTLMRTQVIQESCERRNNIGRALDATEILGFLHSCLNPIIYAFIGQNFRHGFLKILAMHGLVSKEFLARHRVTSYTSSSVNVSSNL

SEQ ID NO: 295 - protein, 360 aa, Homo sapiens
MEDFNMESDSFEDFWKGEDLSNYSYSSTLPPFLLDAAPCEPESLEINKYFVVIIYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRYLVKFICLSIWGLSLLLALPVLLFRRTVYSSNVSPACYEDMGNNTANWRMLLRILPQSFGFIVPLLIMLFCYGFTLRTLFKAHMGQKHRAMRVIFAVVLIFLLCWLPYNLVLLADTLMRTQVIQETCERRNHIDRALDATEILGILHSCLNPLIYAFIGQKFRHGLLKILAIHGLISKDSLPKDSRPSFVGSSSGHTSTTL

SEQ ID NO: 296 - protein, 398 aa, Homo sapiens
MLRLYVLVMGVSAFTLQPAAHTGAARSCRFRGRHYKREFRLEGEPVALRCPQVPYWLWASVSPRINLTWHKNDSARTVPGEEETRMWAQDGALWLLPALQEDSGTYVCTTRNASYCDKMSIELRVFENTDAFLPFISYPQILTLSTSGVLVCPDLSEFTRDKTDVKIQWYKDSLLLDKDNEKFLSVRGTTHLLVHDVALEDAGYYRCVLTFAHEGQQYNITRSIELRIKKKKEETIPVIISPLKTISASLGSRLTIPCKVFLGTGTPLTTMLWWTANDTHIESAYPGGRVTEGPRQEYSENNENYIEVPLIFDPVTREDLHMDFKCVVHNTLSFQTLRTTVKEASSTFSWGIVLAPLSLAFLVLGGIWMHRRCKHRTGKADGLTVLWPHHQDFQSYPK

SEQ ID NO: 297 - protein, 422 aa, Homo sapiens
MSSSCSGLSRVLVAVATALVSASSPCPQAWGPPGVQYGQPGRSVKLCCPGVTAGDPVSWFRDGEPKLLQGPDSGLGHELVLAQADSTDEGTYICQTLDGALGGTVTLQLGYPPARPVVSCQAADYENFSCTWSPSQISGLPTRYLTSYRKKTVLGADSQRRSPSTGPWPCPQDPLGAARCVVHGAEFWSQYRINVTEVNPLGASTRLLDVSLQSILRPDPPQGLRVESVPGYPRRLRASWTYPASWPCQPHFLLKFRLQYRPAQHPAWSTVEPAGLEEVITDAVAGLPHAVRVSARDFLDAGTWSTWSPEAWGTPSTGTIPKEIPAWGQLHTQPEVEPQVDSPAPPRPSLQPHPRLLDHRDSVEQVAVLASLGILSFLGLVAGALALGLWLRLRRGGKDGSPKPGFLASVIPVDRRPGAPNL

SEQ ID NO: 298 - protein, 427 aa, Homo sapiens
MEWPARLCGLWALLLCAGGGGGGGGAAPTETQPPVTNLSVSVENLCTVIWTWNPPEGASSNCSLWYFSHFGDKQDKKIAPETRRSIEVPLNERICLQVGSQCSTNESEKPSILVEKCISPPEGDPESAVTELQCIWHNLSYMKCSWLPGRNTSPDTNYTLYYWHRSLEKIHQCENIFREGQYFGCSFDLTKVKDSSFEQHSVQIMVKDNAGKIKPSFNIVPLTSRVKPDPPHIKNLSFHNDDLYVQWENPQNFISRCLFYEVEVNNSQTETHNVFYVQEAKCENPEFERNVENTSCFMVPGVLPDTLNTVRIRVKTNKLCYEDDKLWSNWSQEMSIGKKRNSTLYITMLLIVPVIVAGAIIVLLLYLKRLKIIIFPPIPDPGKIFKEMFGDQNDDTLHWKKYDIYEKQTKEETDSVVLIENLKKASQ

SEQ ID NO: 299 - protein, 380 aa, Homo sapiens
MAFVCLAIGCLYTFLISTTFGCTSSSDTEIKVNPPQDFEIVDPGYLGYLYLQWQPPLSLDHFKECTVEYELKYRNIGSETWKTIITKNLHYKDGFDLNKGIEAKIHTLLPWQCTNGSEVQSSWAETTYWISPQGIPETKVQDMDCVYYNWQYLLCSWKPGIGVLLDTNYNLFYWYEGLDHALQCVDYIKADGQNIGCRFPYLEASDYKDFYICVNGSSENKPIRSSYFTFQLQNIVKPLPPVYLTFTRESSCEIKLKWSIPLGPIPARCFDYEIEIREDDTTLVTATVENETYTLKTTNETRQLCFVVRSKVNIYCSDDGIWSEWSDKQCWEGEDLSKKTLLRFWLPFGFILILVIFVTGLLLRKPNTYPKMIPEFFCDT

SEQ ID NO: 300 - protein, 825 aa, Homo sapiens
MGWLCSGLLFPVSCLVLLQVASSGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNSYREPFEQHLLLGVSVSCIVILAVCLLCYVSITKIKKEWWDQIPNPARSRLVAIIIQDAQGSQWEKRSRGQEPAKCPHWKNCLTKLLPCFLEHNMKRDEDPHKAAKEMPFQGSGKSAWCPVEISKTVLWPESISVVRCVELFEAPVECEEEEEVEEEKGSFCASPESSRDDFQEGREGIVARLTESLFLDLLGEENGGFCQQDMGESCLLPPSGSTSAHMPWDEFPSAGPKEAPPWGKEQPLHLEPSPPASPTQSPDNLTCTETPLVIAGNPAYRSFSNSLSQSPCPRELGPDPLLARHLEEVEPEMPCVPQLSEPTTVPQPEPETWEQILRRNVLQHGAAAAPVSAPTSGYQEFVHAVEQGGTQASAVVGLGPPGEAGYKAFSSLLASSAVSPEKCGFGASSGEEGYKPFQDLIPGCPGDPAPVPVPLFTFGLDREPPRSPQSSHLPSSSPEHLGLEPGEKVEDMPKPPLPQEQATDPLVDSLGSGIVYSALTCHLCGHLKQCHGQEDGGQTPVMASPCCGCCCGDRSSPPTTPLRAPDPSPGGVPLEASLCPASLAPSGISEKSKSSSSFHPAPGNAQSSSQTPKIVNFVSVGPTYMRVS

SEQ ID NO: 301 - protein, 862 aa, Homo sapiens
MAHTFRGCSLAFMFIITWLLIKAKIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRCTLYWRDEGLVLLNRLRYRPSNSRLWNMVNVTKAKGRHDLLDLKPFTEYEFQISSKLHLYKGSWSDWSESLRAQTPEEEPTGMLDVWYMKRHIDYSRQQISLFWKNLSVSEARGKILHYQVTLQELTGGKAMTQNITGHTSWTTVIPRTGNWAVAVSAANSKGSSLPTRINIMNLCEAGLLAPRQVSANSEGMDNILVTWQPPRKDPSAVQEYVVEWRELHPGGDTQVPLNWLRSRPYNVSALISENIKSYICYEIRVYALSGDQGGCSSILGNSKHKAPLSGPHINAITEEKGSILISWNSIPVQEQMGCLLHYRIYWKERDSNSQPQLCEIPYRVSQNSHPINSLQPRVTYVLWMTALTAAGESSHGNEREFCLQGKANWMAFVAPSICIAIIMVGIFSTHYFQQKVFVLLAALRPQWCSREIPDPANSTCAKKYPIAEEKTQLPLDRLLIDWPTPEDPEPLVISEVLHQVTPVFRHPPCSNWPQREKGIQGHQASEKDMMHSASSPPPPRALQAESRQLVDLYKVLESRGSDPKPENPACPWTVLPAGDLPTHDGYLPSNIDDLPSHEAPLADSLEELEPQHISLSVFPSSSLHPLTFSCGDKLTLDQLKMRCDSLML

SEQ ID NO: 302 - protein, 662 aa, Homo sapiens
MEPLVTWVVPLLFLFLLSRQGAACRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTEPVALNISVGTNGTTMYWPARAQSMTYCIEWQPVGQDGGLATCSLTAPQDPDPAGMATYSWSRESGAMGQEKCYYITIFASAHPEKLTLWSTVLSTYHFGGNASAAGTPHHVSVKNHSLDSVSVDWAPSLLSTCPGVLKEYVVRCRDEDSKQVSEHPVQPTETQVTLSGLRAGVAYTVQVRADTAWLRGVWSQPQRFSIEVQVSDWLIFFASLGSFLSILLVGVLGYLGLNRAARHLCPPLPTPCASSAIEFPGGKETWQWINPVDFQEEASLQEALVVEMSWDKGERTEPLEKTELPEGAPELALDTELSLEDGDRCKAKM

SEQ ID NO: 303 - protein, 521 aa, Homo sapiens
MGLGRCIWEGWTLESEALRRDMGTWLLACICICTCVCLGVSVTGEGQGPRSRTFTCLTNNILRIDCHWSAPELGQGSSPWLLFTSNQAPGGTHKCILRGSECTVVLPPEAVLVPSDNFTITFHHCMSGREQVSLVDPEYLPRRHVKLDPPSDLQSNISSGHCILTWSISPALEPMTTLLSYELAFKKQEEAWEQAQHRDHIVGVTWLILEAFELDPGFIHEARLRVQMATLEDDVVEEERYTGQWSEWSQPVCFQAPQRQGPLIPPWGWPGNTLVAVSIFLLLTGPTYLLFKLSPRVKRIFYQNVPSPAMFFQPLYSVHNGNFQTWMGAHGAGVLLSQDCAGTPQGALEPCVQEATALLTCGPARPWKSVALEEEQEGPGTRLPGNLSSEDVLPAGCTEWRVQTLAYLPQEDWAPTSLTRPAPPDSEGSRSSSSSSSSNNNNYCALGCYGGWHLSALPGNTQSSGPIPALACGLSCDHQGLETQQGVAWVLAGHCQRPGLHEDLQGMLLPSVLSKARSWTF

SEQ ID NO: 304 - protein, 578 aa, Homo sapiens
MLPCLVVLLAALLSLRLGSDAHGTELPSPPSVWFEAEFFHHILHWTPIPNQSESTCYEVALLRYGIESWNSISNCSQTLSYDLTAVTLDLYHSNGYRARVRAVDGSRHSNWTVTNTRFSVDEVTLTVGSVNLEIHNGFILGKIQLPRPKMAPANDTYESIFSHFREYEIAIRKVPGNFTFTHKKVKHENFSLLTSGEVGEFCVQVKPSVASRSNKGMWSKEECISLTRQYFTVTNVIIFFAFVLLLSGALAYCLALQLYVRRRKKLPSVLLFKKPSPFIFISQRPSPETQDTIHPLDEEAFLKVSPELKNLDLHGSTDSGFGSTKPSLQTEEPQFLLPDPHPQADRTLGNREPPVLGDSCSSGSSNSTDSGICLQEPSLSPSTGPTWEQQVGSNSRGQDDSGIDLVQNSEGRAGDTQGGSALGHHSPPEPEVPGEEDPAAVAFQGYLRQTRCAEEKATKTGCLEEESPLTDGLGPKFGRCLVDEAGLHPPALAKGYLKQDPLEMTLASSGAPTGQWNQPTEEWSLLALSSCSDLGISDWSFAHDLAPLGCVAAPGGLLGSFNSDLVTLPLISSLQSSE

SEQ ID NO: 305 - protein, 325 aa, Homo sapiens
MAWSLGSWLGGCLLVSALGMVPPPENVRMNSVNFKNILQWESPAFAKGNLTFTAQYLSYRIFQDKCMNTTLTECDFSSLSKYGDHTLRVRAEFADEHSDWVNITFCPVDDTIIGPPGMQVEVLADSLHMRFLAPKIENEYETWTMKNVYNSWTYNVQYWKNGTDEKFQITPQYDFEVLRNLEPWTTYCVQVRGFLPDRNKAGEWSEPVCEQTTHDETVPSWMVAVILMASVFMVCLALLGCFALLWCVYKKTKYAFSPRNSLPQHLKEFLGHPHHNTLLFFSFPLSDENDVFDKLSVIAEDSESGKQNPGDSCSLGTPPGQGPQS

SEQ ID NO: 306 - protein, 468 aa, Homo sapiens
MLAVGCALLAALLAAPGAALAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTESRSPPAENEVSTPMQALTTNKDDDNILFRDSANATSLPVQDSSSVPLPTFLVAGGSLAFGTLLCIAIVLRFKKTWKLRALKEGKTSMHPPYSLGQLVPERPRPTPVLVPLISPPVSPSSLGSDNTSSHNRPDARDPRSPYDISNTDYFFPR

SEQ ID NO: 307 - protein, 378 aa, Homo sapiens
MVLLWLTLLLIALPCLLQTKEDPNPPITNLRMKAKAQQLTWDLNRNVTDIECVKDADYSMPAVNNSYCQFGAISLCEVTNYTVRVANPPFSTWILFPENSGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQIQKRMQPVITEQVRDRTSFQLLNPGTYTVQIRARERVYEFLSAWSTPQRFECDQEEGANTRAWRTSLLIALGTLLALVCVFVICRRYLVMQRLFPRIPHMKDPIGDSFQNDKLVVWEAGKAGLEECLVTEVQVVQKT

SEQ ID NO: 308 - protein, 400 aa, Homo sapiens
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWKQPRTYQKLSYLDFQYQLDVHRKNTQPGTENLLINVSGDLENRYNFPSSEPRAKHSVKIRAADVRILNWSSWSEAIEFGSDDGNLGSVYIYVLLIVGTLVCGIVLGFLFKRFLRIQRLFPPVPQIKDKLNDNHEVEDEIIWEEFTPEEGKGYREEVLTVKEIT

SEQ ID NO: 309 - protein, 897 aa, Homo sapiens
MVLAQGLLSMALLALCWERSLAGAEETIPLQTLRCYNDYTSHITCRWADTQDAQRLVNVTLIRRVNEDLLEPVSCDLSDDMPWSACPHPRCVPRRCVIPCQSFVVTDVDYFSFQPDRPLGTRLTVTLTQHVQPPEPRDLQISTDQDHFLLTWSVALGSPQSHWLSPGDLEFEVVYKRLQDSWEDAAILLSNTSQATLGPEHLMPSSTYVARVRTRLAPGSRLSGRPSKWSPEVCWDSQPGDEAQPQNLECFFDGAAVLSCSWEVRKEVASSVSFGLFYKPSPDAGEEECSPVLREGLGSLHTRHHCQIPVPDPATHGQYIVSVQPRRAEKHIKSSVNIQMAPPSLNVTKDGDSYSLRWETMKMRYEHIDHTFEIQYRKDTATWKDSKTETLQNAHSMALPALEPSTRYWARVRVRTSRTGYNGIWSEWSEARSWDTESVLPMWVLALIVIFLTIAVLLALRFCGIYGYRLRRKWEEKIPNPSKSHLFQNGSAELWPPGSMSAFTSGSPPHQGPWGSRFPELEGVFPVGFGDSEVSPLTIEDPKHVCDPPSGPDTTPAASDLPTEQPPSPQPGPPAASHTPEKQASSFDFNGPYLGPPHSRSLPDILGQPEPPQEGGSQKSPPPGSLEYLCLPAGGQVQLVPLAQAMGPGQAVEVERRPSQGAAGSPSLESGGGPAPPALGPRVGGQDQKDSPVAIPMSSGDTEDPGVASGYVSSADLVFTPNSGASSVSLVPSLGLPSDQTPSLCPGLASGPPGAPGPVKSGFEGYVELPPIEGRSPRSPRNNPVPPEAKSPVLNPGERPADVSPTSPQPEGLLVLQQVGDYCFLPGLGPGPLSLRSKPSSPGPGPEIKNLDQAFQVKKPPGQAVPQVPVIQLFKALKQQDYLSLPPWEVNKPGEVC

SEQ ID NO: 310 - protein, 420 aa, Homo sapiens
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGSPGTSIVNLTCTTNTTEDNYSRLRSYQVSLHCTWLVGTDAPEDTQYFLYYRYGSWTEECQEYSKDTLGRNIACWFPRTFILSKGRDWLAVLVNGSSKHSAIRPFDQLFALHAIDQINPPLNVTAEIEGTRLSIQWEKPVSAFPIHCFDYEVKIHNTRNGYLQIEKLMTNAFISIIDDLSKYDVQVRAAVSSMCREAGLWSEWSQPIYVGNDEHKPLREWFVIVIMATICFILLILSLICKICHLWIKLFPPIPAPKSNIKDLFVTTNYEKAGSSETEIEVICYIEKPGVETLEDSVF

SEQ ID NO: 311 - protein, 459 aa, Homo sapiens [sequence omitted]

SEQ ID NO: 312 - protein, 508 aa, Homo sapiens
MDHLGASLWPQVGSLCLLLAGAAWAPPPNLPDPKFESKAALLAARGPEELLCFTERLEDLVCFWEEAASAGVGPGNYSFSYQLEDEPWKLCRLHQAPTARGAVRFWCSLPTADTSSFVPLELRVTAASGAPRYHRVIHINEVVLLDAPVGLVARLADESGHVVLRWLPPPETPMTSHIRYEVDVSAGNGAGSVQRVEILEGRTECVLSNLRGRTRYTFAVRARMAEPSFGGFWSAWSEPVSLLTPSDLDPLILTLSLILVVILVLLTVLALLSHRRALKQKIWPGIPSPESEFEGLFTTHKGNFQLWLYQNDGCLWWSPCTPFTEDPPASLEVLSERCWGTMQAVEPGTDDEGPLLEPVGSEHAQDTYLVLDKWLLPRNPPSEDLPGPGGSVDIVAMDEGSEASSCSSALASKPSPEGASAASFEYTILDPSSQLLRPWTLCPELPPTPPHLKYLYLVVSDSGISTDYSSGDSQGAQGGLSDGPYSNPYENSLIPAAEPLPPSYVACS

SEQ ID NO: 313 - protein, 267 aa, Homo sapiens
MAPRRARGCRTLGLPALLLLLLLRPPATRGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 314 - protein, 255 aa, Homo sapiens
MGNSCYNIVATLLLVLNFERTRSLQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 315 - protein, 184 aa, Homo sapiens
MLQMAGQCSQNEYFDSLLHACIPCQLRCSSNTPPLTCQRYCNASVTNSVKGTNAILWTCLGLSLIISLAVFVLMFLLRKINSEPLKDEFKNTGSGLLGMANIDLEKSRTGDEIILPRGLEYTVEECTCEDCIKSKPKVDSDHCFPLPAMEEGATILVTTKTNDYCKSLPAALSATEIEKSISAR

SEQ ID NO: 316 - protein, 260 aa, Homo sapiens
MARPHPWWLCVLGTLVGLSATPAPKSCPERHYWAQGKLCCQMCEPGTFLVKDCDQHRKAAQCDPCIPGVSFSPDHHTRPHCESCRHCNSGLLVRNCTITANAECACRNGWQCRDKECTECDPLPNPSLTARSSQALSPHPQPTHLPYVSEMLEARTAGHMQTLADFRQLPARTLSTHWPPQRSLCSSDFIRILVIFSGMFLVFTLAGALFLHQRRKYRSNKGESPVEPAEPCHYSCPREEEGSTIPIQEDYRKPEPACSP

SEQ ID NO: 317 - protein, 595 aa, Homo sapiens
MRVLLAALGLLFLGALRAFPQDRPFEDTCHGNPSHYYDKAVRRCCYRCPMGLFPTQQCPQRPTDCRKQCEPDYYLDEADRCTACVTCSRDDLVEKTPCAWNSSRVCECRPGMFCSTSAVNSCARCFFHSVCPAGMIVKFPGTAQKNTVCEPASPGVSPACASPENCKEPSSGTIPQAKPTPVSPATSSASTMPVRGGTRLAQEAASKLTRAPDSPSSVGRPSSDPGLSPTQPCPEGSGDCRKQCEPDYYLDEAGRCTACVSCSRDDLVEKTPCAWNSSRTCECRPGMICATSATNSCARCVPYPICAAETVTKPQDMAEKDTTFEAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 318 - protein, 277 aa, Homo sapiens
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGPQDRLRALVVIPIIFGILFAILLVLVFIKKVAKKPTNKAPHPKQEPQEINFPDDLPGSNTAAPVQETLHGCQPVTQEDGKESRISVQERQ

SEQ ID NO: 319 - protein, 448 aa, Homo sapiens
MAHVGDCTQTPWLPVLVVSLMCSARAEYSNCGENEYYNQTTGLCQECPPCGPGEEPYLSCGYGTKDEDYGCVPCPAEKFSKGGYQICRRHKDCEGFFRATVLTPGDMENDAECGPCLPGYYMLENRPRNIYGMVCYSCLLAPPNTKECVGATSGASANFPGTSGSSTLSPFQHAHKELSGQGHLATALIIAMSTIFIMAIAIVLIIMFYILKTKPSAPACCTSHPGKSVEAQVSKDEEKKEAPDNVVMFSEKDEFEKLTATPAKPTKSENDASSENEQLLSRSVDSDEEPAPDKQGSPELCLLSLVHLAREKSATSNKSAGIQSRRKKILDVYANVCGVVEGLSPTELPFDCLEKTSRMLSSTYNSEKAVVKTWRHLAESFGLKRDEIGGMTDGMQLFDRISTAGYSIPELLTKLVQIERLDAVESLCADILEWAGVVPPASQPHAAS

SEQ ID NO: 320 - protein, 277 aa, Homo sapiens
MCVGARRLGRGPCAALLLLGLGLSTVTGLHCVGDTYPSNDRCCHECRPGNGMVSRCSRSQNTVCRPCGPGFYNDVVSSKPCKPCTWCNLRSGSERKQLCTATQDTVCRCRAGTQPLDSYKPGVDCAPCPPGHFSPGDNQACKPWTNCTLAGKHTLQPASNSSDAICEDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 321 - protein, 293 aa, Homo sapiens
MSGLGRSRRGGRSRVDQEERFPQGLWTGVAMRSCPEEQYWDPLLGTCMSCKTICNHQSQRTCAAFCRSLSCRKEQGKFYDHLLRDCISCASICGQHPKQCAYFCENKLRSPVNLPPELRRQRSGEVENNSDNSGRYQGLEHRGSEASPALPGLKLSADQVALVYSTLGLCLCAVLCCFLVAVACFLKKRGDPCSCQPRSRPRQSPAKSSQDHAMEAGSPVSTSPEPVETCSFCFPECRAPTQESAVTPGTPDPTCAGRWGCHTRTTVLQPCPHIPDSGLGIVCVPAQEGGPGA

SEQ ID NO: 322 - protein, 455 aa, Homo sapiens
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTTVLLPLVIFFGLCLLSLLFIGLMYRYQRWKSKLYSIVCGKSTPEKEGELEGTTTKPLAPNPSFSPTPGFTPTLGFSPVPSSTFTSSSTYTPGDCPNFAAPRREVAPPYQGADPILATALASDPIPNPLQKWEDSAHKPQSLDTDDPATLYAVVENVPPLRWKEFVRRLGLSDHEIDRLELQNGRCLREAQYSMLATWRRRTPRREATLELLGRVLRDMDLLGCLEDIEEALCGPAALPPAPSLLR

SEQ ID NO: 323 - protein, 461 aa, Homo sapiens
MAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDFALPVGLIVGVTALGLLIIGVVNCVIMTQVKKKPLCLQREAKVPHLPADKARGTQGPEQQHLLITAPSSSSSSLESSASALDRRAPTRNQPQAPGVEASGAGEARASTGSSDSSPGGHGTQVNVTCIVNVCSSSDHSSQCSSQASSTMGDTDSSPSESPKDEQVPFSKEECAFRSQLETPETLLGSTEEKPLPLGVPDAGMKPS

SEQ ID NO: 324 - protein, 423 aa, Homo sapiens
MALKVLLEQEKTFFTLLVLLGYLSCKVTCESGDCRQQEFRDRSGNCVPCNQCGPGMELSKECGFGYGEDAQCVTCRLHRFKEDWGFQKCKPCLDCAVVNRFQKANCSATSDAICGDCLPGFYRKTKLVGFQDMECVPCGDPPPPYEPHCASKVNLVKIASTASSPRDTALAAVICSALATVLLALLILCVIYCKRQFMEKKPSWSLRSQDIQYNGSELSCFDRPQLHEYAHRACCQCRRDSVQTCGPVRLLPSMCCEEACSPNPATLGCGVHSAASLQARNAGPAGEMVPTFFGSLTQSICGEFSDAWPLMQNPMGGDNISFCDSYPELTGEDIHSLNPELESSTSLDSNSSQDLVGGAVPVQSHSENFTAATDLSRYNNTLVESASTQDALTMRSQLDQESGAVIHPATQTSLQVRQRLGSL

SEQ ID NO: 325 - protein, 233 aa, Homo sapiens
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 326 - protein, 205 aa, Homo sapiens
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 327 - protein, 244 aa, Homo sapiens
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGAETVTPVLDPARRQGYGPLWYTSVGFGGLVQLRRGERVYVNISHPDMVDFARGKTFFGAVMVG

SEQ ID NO: 328 - protein, 317 aa, Homo sapiens
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGFFKLRSGEEISIEVSNPSLLDPDQDATYFGAFKVRDID

SEQ ID NO: 329 - protein, 281 aa, Homo sapiens; identical to SEQ ID NO: 204

SEQ ID NO: 330 - protein, 193 aa, Homo sapiens
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 331 - protein, 234 aa, Homo sapiens
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCESGMQTKHVYQNLSQFLLDYLQVNTTISVNVDTFQYIDTSTFPLENVLSIFLYSNSD

SEQ ID NO: 332 - protein, 261 aa, Homo sapiens
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 333 - protein, 254 aa, Homo sapiens
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 334 - protein, 300 aa, Homo sapiens
MRALEGPGLSLLCLVLALPALLPVPAVRGVAETPTYPWRDAETGERLVCAQCPPGTFVQRPCRRDSPTTCGPCPPRHYTQFWNYLERCRYCNVLCGEREEEARACHATHNRACRCRTGFFAHAGFCLEHASCPPGAGVIAPGTPSQNTQCQPCPPGTFSASSSSSEQCQPHRNCTALGLALNVPGSSSHDTLCTSCTGFPLSTRVPGAEECERAVIDFVAFQDISIKRLQRLLQALEAPEGWGPTPRAGRAALQLKLRRRLTELLGAQDGALLVRLLQALRVARMPGLERSVRERFLPVH

SEQ ID NO: 335 - protein, 183 aa, Homo sapiens
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 336 - protein, 99 aa, Homo sapiens
MKASAALLCLLLTAAAFSPQGLAQPVGINTSTTCCYRFINKKIPKQRLESYRRTTSSHCPREAVIFKTKLDKEICADPTQKWVQDFMKHLDKKTQTPKL

SEQ ID NO: 337 - protein, 99 aa, Homo sapiens
MKVSAALLCLLLIAATFIPQGLAQPDAINAPVTCCYNFTNRKISVQRLASYRRITSSKCPKEAVIFKTIVAKEICADPKQKWVQDSMDHLDKQTQTPKT

SEQ ID NO: 338 - protein, 107 aa, Homo sapiens
MARATLSAAPSNPRLLRVALLLLLLVAASRRAAGAPLATELRCQCLQTLQGIHLKNIQSVKVKSPGPHCAQTEVIATLKNGQKACLNPASPMVKKIIEKMLKNGKSN

SEQ ID NO: 339 - protein, 107 aa, Homo sapiens
MAHATLSAAPSNPRLLRVALLLLLLVAASRRAAGASVVTELRCQCLQTLQGIHLKNIQSVNVRSPGPHCAQTEVIATLKNGKKACLNPASPMVQKIIEKILNKGSTN

SEQ ID NO: 340 - protein, 107 aa, Homo sapiens
MARAALSAAPSNPRLLRVALLLLLLVAAGRRAAGASVATELRCQCLQTLQGIHPKNIQSVNVKSPGPHCAQTEVIATLKNGRKACLNPASPIVKKIIEKMLNSDKSN

SEQ ID NO: 341 - protein, 99 aa, Homo sapiens
MTSKLAVALLAAFLISAALCEGAVLPRSAKELRCQCIKTYSKPFHPKFIKELRVIESGPHCANTEIIVKLSDGRELCLDPKENWVQRVVEKFLKRAENS

SEQ ID NO: 342 - protein, 113 aa, Homo sapiens
MKVSVAALSCLMLVAVLGSQAQFINDAETELMMSKLPLENPVVLNSFHFAADCCTSYISQSIPCSLMKSYFETSSECSKPGVIFLTKKGRQVCAKPSGPGVQDCMKKLKPYSI

SEQ ID NO: 343 - protein, 93 aa, Homo sapiens
MKISVAAIPFFLLITIALGTKTESSSRGPYHPSECCFTYTTYKIPRQRIMDYYETNSQCSKPGIVFITKRGHSVCTNPSDKWVQDYIKDMKEN

SEQ ID NO: 344 - protein, 99 aa, Homo sapiens
MKVSAALLCLLLMAATFSPQGLAQPDSVSIPITCCFNVINRKIPIQRLESYTRITNIQCPKEAVIFKTKRGKEVCADPKERWVRDSMKHLDQIFQNLKP

SEQ ID NO: 345 - protein, 93 aa, Homo sapiens
MDRLQTALLVVLVLLAVALQATEAGPYGANMEDSVCCRDYVRYRLPLRVVKHFYWTSDSCPRPGVVLLTFRDKEICADPRVPWVKMILNKLSQ

SEQ ID NO: 346 - protein, 134 aa, Homo sapiens; identical to SEQ ID NO: 246

SEQ ID NO: 347 - protein, 98 aa, Homo sapiens
MKVSAVLLCLLLMTAAFNPQGLAQPDALNVPSTCCFTFSSKKISLQRLKSYVITTSRCPQKAVIFRTKLGKEICADPKEKWVQNYMKHLGRKAHTLKT

SEQ ID NO: 348 - protein, 150 aa, Homo sapiens
MNLWLLACLVAGFLGAWAPAVHTQGVFEDCCLAYHYPIGWAVLRRAWTYRIQEVSGSCNLPAAIFYLPKRHRKVCGNPKSREVQRAMKLLDARNKVFAKLHHNTQTFQAGPHAVKKLSSGNSKLSSSKFSNPISSSKRNVSLLISANSGL

SEQ ID NO: 349 - protein, 94 aa, Homo sapiens
MMGLSLASAVLLASLLSLHLGTATRGSDISKTCCFQYSHKPLPWTWVRSYEFTSNSCSQRAVIFTTKRGKKVCTHPRKKWVQKYISLLKTPKQL

SEQ ID NO: 350 - protein, 111 aa, Homo sapiens
MSLLPRRAPPVSMRLLAAALLLLLLALYTARVDGSKCKCSRKGPKIRYSDVKKLEMKPKYPHCEEKMVIITTKSVSRYRGQEHCLHPKLQSTKRFIKWYNAWNEKRRVYEE

SEQ ID NO: 351 - protein, 125 aa, Homo sapiens
MKKSGVLFLLGIILLVLIGVQGTPVVRKGRCSCISTNQGTIHLQSLKDLKQFAPSPSCEKIEIIATLKNGVQTCLNPDSADVKELIKKWEKQVSQKKKQKNGKKHQKKKVLKVRKSQRSRQKKTT

SEQ ID NO: 352 - protein, 114 aa, Homo sapiens
MSLLSSRAARVPGPSSSLCALLVLLLLLTQPGPIASAGPAAAVLRELRCVCLQTTQGVHPKMISNLQVFAIGPQCSKVEVVASLKNGKEICLDPEAPFLKKVIQKILDGGNKEN

SEQ ID NO: 353 - protein, 128 aa, Homo sapiens
MSLRLDTTPSCNSARPLHALQVLLLLSLLLTALASSTKGQTKRNLAKGKEESLDSDLYAELRCMCIKTTSGIHPKNIQSLEVIGKGTHCNQVEVIATLKDGRKICLDPDAPRIKKIVQKKLAGDESAD

SEQ ID NO: 354 - protein, 85 aa, Homo sapiens
NLAKGKEESLDSDLYAELRCMCIKTTSGIHPKNIQSLEVIGKGTHCNQVEVIATLKDGRKICLDPDAPRIKKIVQKKLAGDESAD

SEQ ID NO: 355 - protein, 81 aa, Homo sapiens
GKEESLDSDLYAELRCMCIKTTSGIHPKNIQSLEVIGKGTHCNQVEVIATLKDGRKICLDPDAPRIKKIVQKKLAGDESAD

SEQ ID NO: 356 - protein, 70 aa, Homo sapiens
AELRCMCIKTTSGIHPKNIQSLEVIGKGTHCNQVEVIATLKDGRKICLDPDAPRIKKIVQKKLAGDESAD

SEQ ID NO: 357 - protein, 114 aa, Homo sapiens
MSLPSSRAARVPGPSGSLCALLALLLLLTPPGPLASAGPVSAVLTELRCTCLRVTLRVNPKTIGKLQVFPAGPQCSKVEVVASLKNGKQVCLDPEAPFLKKVIQKILDSGNKKN

SEQ ID NO: 358 - protein, 92 aa, Homo sapiens
MKLCVTVLSLLMLVAAFCSPALSAPMGSDPPTACCFSYTARKLPRNFVVDYYETSSLCSQPAVVFQTKRSKQVCADPSESWVQEYVYDLELN

SEQ ID NO: 359 - protein, 101 aa, Homo sapiens
MSSAAGFCASRPGLLFLGLLLLPLVVAFASAEAEEDGDLQCLCVKTTSQVRPRHITSLEVIKAGPHCPTAQLIATLKNGRKICLDLQAPLYKKIIKKLLES

SEQ ID NO: 360 - protein, 96 aa, Homo sapiens
MQIITTALVCLLLAGMWPEDVDSKSMQVPFSRCCFSFAEQEIPLRAILCYRNTSSICSNEGLIFKLKRGKEACALDTVGWVQRHRKMLRHCPSKRK

SEQ ID NO: 361 - protein, 93 aa, Homo sapiens; identical to SEQ ID NO: 343

SEQ ID NO: 362 - protein, 374 aa, Homo sapiens
MLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYHIGYFGGIFFIILLTIDRYLAIVHAVFALKARTVTFGVVTSVITWLVAVFASVPGIIFTKCQKEDSVYVCGPYFPRGWNNFHTIMRNILGLVLPLLIMVICYSGILKTLLRCRNEKKRHRAVRVIFTIMIVYFLFWTPYNIVILLNTFQEFFGLSNCESTSQLDQATQVTETLGMTHCCINPIIYAFVGEKFRSLFHIALGCRIAPLQKPVCGGPGVRPGKNVKVTTQGLLDGRGKGKSIGRAPEASLQDKEGA

SEQ ID NO: 363 - protein, 94 aa, Homo sapiens
MSVKGMAIALAVILCATVVQGFPMFKRGRCLCIGPGVKAVKVADIEKASIMYPSNNCDKIEVIITLKENKGQRCLNPKSKQARLIIKKVERKNF

SEQ ID NO: 364 - protein, 92 aa, Homo sapiens
MQVSTAALAVLLCTMALCNQFSASLAADTPTACCFSYTSRQIPQNFIADYFETSSQCSKPGVIFLTKRSRQVCADPSEEWVQKYVSDLELSA

SEQ ID NO: 365 - protein, 180 aa, Homo sapiens
MLCLLLTLGVALVCGVPAMDIPQTKQDLELPKLAGTWHSMAMATNNISLMATLKAPLRVHITSLLPTPEDNLEIVLHRWENNSCVEKKVLGEKTENPKKFKINYTVANEATLLDTDYDNFLFLCLQDTTTPIQSMMCQYLARVLVEDDEIMQGFIRAFRPLPRHLWYLLDLKQMEEPCRF

SEQ ID NO: 366 - protein, 1192 aa, Homo sapiens [sequence omitted]

SEQ ID NO: 367 - protein, 373 aa, Homo sapiens
MEDLDQSPLVSSSDSPPRPQPAFKYQFVREPEDEEEEEEEEEEDEDEDLEELEVLERKPAAGLSAAPVPTAPAAGAPLMDFGNDFVPPAPRGPLPAAPPVAPERQPSWDPSPVSSTVPAPSPLSAAAVSPSKLPEDDEPPARPPPPPPASVSPQAEPVWTPPAPAPAAPPSTPAAPKRRGSSGSVVVDLLYWRDIKKTGVVFGASLFLLLSLTVFSIVSVTAYIALALLSVTISFRIYKGVIQAIQKSDEGHPFRAYLESEVAISEELVQKYSNSALGHVNCTIKELRRLFLVDDLVDSLKFAVLMWVFTYVGALFNGLTLLILALISLFSVPVIYERHQAQIDHYLGLANKNVKDAMAKIQAKIPGLKRKAE

SEQ ID NO: 368 - protein, 199 aa, Homo sapiens
MDGQKKNWKDKVVDLLYWRDIKKTGVVFGASLFLLLSLTVFSIVSVTAYIALALLSVTISFRIYKGVIQAIQKSDEGHPFRAYLESEVAISEELVQKYSNSALGHVNCTIKELRRLFLVDDLVDSLKFAVLMWVFTYVGALFNGLTLLILALISLFSVPVIYERHQAQIDHYLGLANKNVKDAMAKIQAKIPGLKRKAE

SEQ ID NO: 369 - protein, 473 aa, Homo sapiens
MKRASAGGSRLLAWVLWLQAWQVAAPCPGACVCYNEPKVTTSCPQQGLQAVPVGIPAASQRIFLHGNRISHVPAASFRACRNLTILWLHSNVLARIDAAAFTGLALLEQLDLSDNAQLRSVDPATFHGLGRLHTLHLDRCGLQELGPGLFRGLAALQYLYLQDNALQALPDDTFRDLGNLTHLFLHGNRISSVPERAFRGLHSLDRLLLHQNRVAHVHPHAFRDLGRLMTLYLFANNLSALPTEALAPLRALQYLRLNDNPWVCDCRARPLWAWLQKFRGSSSEVPCSLPQRLAGRDLKRLAANDLQGCAVATGPYHPIWTGRATDEEPLGLPKCCQPDAADKASVLEPGRPASAGNALKGRVPPGDSPPGNGSGPRHINDSPFGTLPGSAEPPLTAVRPEGSEPPGFPTSGPRRRPGCSRKNRTRSHCRLGQAGSGGGGTGDSEGSGALPSLTCSLTPLGLALVLWTVLGPC

SEQ ID NO: 370 - protein, 317 aa, Homo sapiens
MAKNPPENCEDCHILNAEAFKSKKICKSLKICGLVFGILALTLIVLFWGSKHFWPEVPKKAYDMEHTFYSNGEKKKIYMEIDPVTRTEIFRSGNGTDETLEVHDFKNGYTGIYFVGLQKCFIKTQIKVIPEFSEPEEEIDENEEITTTFFEQSVIWVPAEKPIENRDFLKNSKILEICDNVTMYWINPTLISVSELQDFEEEGEDLHFPANEKKGIEQNEQWVVPQVKVEKTRHARQASEEELPINDYTENGIEFDPMLDERGYCCIYCRRGNRYCRRVCEPLLGYYPYPYCYQGGRVICRVIMPCNWWVARMLGRV

SEQ ID NO: 371 - protein, 164 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKYVGARCCLMPWSLPGPQCDKPRR

SEQ ID NO: 372 - protein, 188 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVYVGARCCLMPWSLPGPQCDKPRR

SEQ ID NO: 373 - protein, 208 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKYVGARCCLMPWSLPGPHPCGPCSERRKHLFVQDPQTCKCSCKNTDSRCKARQLELNERTCRCDKPRR

SEQ ID NO: 374 - protein, 354 aa, Homo sapiens
MYREWVVVNVFMMLYVQLVQGSSNEHGPVKRSSQSTLERSEQQIRAASSLEELLRITHSEDWKLWRCRLRLKSFTSMDSRSASHRSTRFAATFYDIETLKVIDEEWQRTQCSPRETCVEVASELGKSTNTFFKPPCVNVFRCGGCCNEESLICMNTSTSYISKQLFEISVPLTSVPELVPVKVANHTGCKCLPTAPRHPYSIIRRSIQIPEEDRCSHSKKLCPIDMLWDSNKCKCVLQEENPLAGTEDHSHLQEPALCGPHMMFDEDRCECVCKTPCPKDLIQHPKNCSCFECKESLETCCQKHKLFHPDTCSCEDRCPFHTRPCASGKTACAKHCRFPKEKRAAQGPHSRKNP

SEQ ID NO: 375 - protein, 160 aa, Homo sapiens; identical to SEQ ID NO: 234

SEQ ID NO: 376 - protein, 182 aa, Homo sapiens; identical to SEQ ID NO: 235

SEQ ID NO: 377 - protein, 258 aa, Homo sapiens; identical to SEQ ID NO: 236

SEQ ID NO: 378 - protein, 355 aa, Homo sapiens
MDYTLDLSVTTVTDYYYPDIFSSPCDAELIQTNGKLLLAVFYCLLFVFSLLGNSLVILVLEVCKKLRSITDVYLLNLALSDLLFVFSFPFQTYYLLDQWVFGTVMCKVVSGFYYIGFYSSMFFITLMSVDRYLAVVHAVYALKVRTIRMGTTLCLAVWLTAIMATIPLLVFYQVASEDGVLQCYSFYNQQTLKWKIFTNFKMNILGLLIPFTIFMFCYIKILHQLKRCQNHNKTKAIRLVLIVVIASLLFWVPFNVVLFLTSLHSMHILDGCSISQQLTYATHVTEIISFTHCCVNPVIYAFVGEKFKKHLSEIFQKSCSQIFNYLGRQMPRESCEKSSSCQQHSSRSSNVDYIL

SEQ ID NO: 379 - protein, 355 aa, Homo sapiens
METPNTTEDYDTTTEFDYGDATPCQKVNERAFGAQLLPPLYSLVFVIGLVGNILVVLVLVQYKRLKNMTSIYLLNLAISDLLFLFTLPFWIDYKLKDDWVFGDAMCKILSGFYYTGLYSEIFFIILLTIDRYLAIVHAVFALRARTVTFGVITSIIIWALAILASMPGLYFSKTQWEFTHHTCSLHFPHESLREWKLFQALKLNLFGLVLPLLVMIICYTGIIKILLRRPNEKKSKAVRLIFVIMIIFFLFWTPYNLTILISVFQDFLFTHECEQSRHLDLAVQVTEVIAYTHCCVNPVIYAFVGERFRKYLRQLFHRRVAVHLVKWLPFLSVDRLERVSSTSPSTGEHELSAGF

SEQ ID NO: 380 - protein, 92 aa, Homo sapiens; identical to SEQ ID NO: 364

SEQ ID NO: 381 - protein, 93 aa, Homo sapiens
MQVSTAALAVLLCTMALCNQVLSAPLAADTPTACCFSYTSRQIPQNFIADYFETSSQCSKPSVIFLTKRGRQVCADPSEEWVQKYVSDLELSA

SEQ ID NO: 382 - protein, 211 aa, Homo sapiens [sequence omitted]

SEQ ID NO: 383 - protein, 196 aa, Homo sapiens
MRTLACLLLLGCGYLAHVLAEEAEIPREVIERLARSQIHSIRDLQRLLEIDSVGSEDSLDTSLRAHGVHATKHVPEKRPLPIRRKRSIEEAVPAVCKTRTVIYEIPRSQVDPTSANFLIWPPCVEVKRCTGCCNTSSVKCQPSRVHHRSVKVAKVEYVRKKPKLKEVQVRLEEHLECACATTSLNPDYREEDTDVR

SEQ ID NO: 384 - protein, 271 aa, Homo sapiens
MLLTSSLHHPRHQMSPGSWKKLIILLSCVFGGGGTSLQNKNPHQPMTLTWQGDPIPEELYKMLSGHSIRSFNDLQRLLQGDSGKEDGAELDLNMTRSHSGGELESLARGKRSLGSLSVAEPAMIAECKTRTEVFEISRRLIDRTNANFLVWPPCVEVQRCSGCCNNRNVQCRPTQVQLRPVQVRKIEIVRKKPIFKKATVTLEDHLACKCEIVAAARAVTRSPGTSQEQRAKTTQSRVTIRTVRVRRPPKGKHRKCKHTHDKTALKETLGA

SEQ ID NO: 385 - protein, 11 aa, Homo sapiens
RPKPQQFFGLM

SEQ ID NO: 386 - protein, 153 aa, Homo sapiens
APVRSLNCTLRDSQQKSLVMSGPYELKALHLQGQDMEQQVVFSMSFVQGEESNDKIPVALGLKEKNLYLSCVLKDDKPTLQLESVDPKNYPKKKMEKRFVFNKIEINNKLEFESAQFPNWYISTSQAENMPVFLGGTKGGQDITDFTMQFVSS

SEQ ID NO: 387 - protein, 144 aa, Homo sapiens; identical to SEQ ID NO: 279

SEQ ID NO: 388 - protein, 144 aa, Homo sapiens
MLLAMVLTSALLLCSVAGQGCPTLAGILDINFLINKMQEDPASKCHCSANVTSCLCLGIPSDNCTRPCFSERLSQMTNTTMQTRYPLIFSRVKKSVEVLKNNKCPYFSCEQPCNQTMAGNALTFLKSLLEIFQKEKMRGMRGKI

SEQ ID NO: 389 - protein, 126 aa, Homo sapiens
QGCPTLAGILDINFLINKMQEDPASKCHCSANVTSCLCLGIPSDNCTRPCFSERLSQMTNTTMQTRYPLIFSRVKKSVEVLKNNKCPYFSCEQPCNQTTAGNALTFLKSLLEIFQKEKMRGMRGKI

SEQ ID NO: 390 - protein, 126 aa, Homo sapiens
QGCPTLAGILDINFLINKMQEDPASKCHCSANVTSCLCLGIPSDNCTRPCFSERLSQMTNTTMQTRYPLIFSRVKKSVEVLKNNKCPYFSCEQPCNQTMAGNALTFLKSLLEIFQKEKMRGMRGKI

SEQ ID NO: 391 - protein, 261 aa, Homo sapiens
MLQAEAVQSPCGRKEHAECKTERRPEAGTHKREETGGNLRRESWGMVGRVRPEPGRPLRAMGKGPWTPSLGPDRDLALPPLTCGFPPQLFLLTISIFLGLGQPRSPKSKRKGQGRPGPLAPGPHQVPLDLVSRMKPYARMEEYERNIEEMVAQLRNSSELAQRKCEVNLQLWMSNKRSLSPWGYSINHDPSRIPVDLPEARCLCLGCVNPFTMQEDRSMVSVPVFSQVPVRRRLCPPPPRTGPCRQRAVMETIAVGCTCIF

SEQ ID NO: 392 - protein, 180 aa, Homo sapiens
MDWPHNLLFLLTISIFLGLGQPRSPKSKRKGQGRPGPLAPGPHQVPLDLVSRMKPYARMEEYERNIEEMVAQLRNSSELAQRKCEVNLQLWMSNKRSLSPWGYSINHDPSRIPVDLPEARCLCLGCVNPFTMQEDRSMVSVPVFSQVPVRRRLCPPPPRTGPCRQRAVMETIAVGCTCIF

SEQ ID NO: 393 - protein, 662 aa, Homo sapiens; identical to SEQ ID NO: 302

SEQ ID NO: 394 - protein, 862 aa, Homo sapiens; identical to SEQ ID NO: 301

SEQ ID NO: 395 - protein, 396 aa, Homo sapiens
MEFLKTCVLRRNACTAVCFWRSKVVQKPSVRRISTTSPRSTVMPAWVIDKYGKNEVLRFTQNMMMPIIHYPNEVIVKVHAASVNPIDVNMRSGYGATALNMKRDPLHVKIKGEEFPLTLGRDVSGVVMECGLDVKYFKPGDEVWAAVPPWKQGTLSEFVVVSGNEVSHKPKSLTHTQAASLPYVALTAWSAINKVGGLNDKNCTGKRVLILGASGGVGTFAIQVMKAWDAHVTAVCSQDASELVRKLGADDVIDYKSGSVEEQLKSLKPFDFILDNVGGSTETWAPDFLKKWSGATYVTLVTPFLLNMDRLGIADGMLQTGVTVGSKALKHFWKGVHYRWAFFMASGPCLDDIAELVDAGKIRPVIEQTFPFSKVPEAFLKVERGHARGKTVINVV

SEQ ID NO: 396 - protein, 570 aa, Homo sapiens
MTLLWCVVSLYFYGILQSDASERCDDWGLDTMRQIQVFEDEPARIKCPLFEHFLKFNYSTAHSAGLTLIWYWTRQDRDLEEPINFRLPENRISKEKDVLWFRPTLLNDTGNYTCMLRNTTYCSKVAFPLEVVQKDSCFNSPMKLPVHKLYIEYGIQRITCPNVDGYFPSSVKPTITWYMGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGKKPDDITIDVTINESISHSRTEDETRTQILSIKKVTSEDLKRSYVCHARSAKGEVAKAAKVTQKVPAPRYTVELACGFGATVLLVVILIVVYHVYWLEMVLFYRAHFGTDETILDGKEYDIYVSYARNAEEEEFVLLTLRGVLENEFGYKLCIFDRDSLPGGIVTDETLSFIQKSRRLLVVLSPNYVLQGTQALLELKAGLENMGSRGNINVILVQYKAVKETKVKELKRAKTVLTVIKWKGEKSKYPQGRFWKQLQVAMPVKKSPRRSSSDEQGLSYSSLKNV

SEQ ID NO: 397 - protein, 357 aa, Homo sapiens
MTLLWCWSLYFYGILQSDASERCDDWGLDTHRQIQVFEDEPARIKCPLFEHFLKFNYSTAHSAGLTLIWYWTRQDRDLEEPINFRLPENRISKEKDVLWFRPTLLNDTGNYTCMLRNTTYCSKVAFPLEWQKDSCFNSPMKLPVHKLYIEYGIQRITCPNVDGYFPSSVKPTITNYMGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGKKPDDITIDVTINESISHSRTEDETRTQILSIKKVTSEDLKRSYVCHARSAKGEVAKAAKVTQKVPAPRYTVE

SEQ ID NO: 398 - protein, 562 aa, Homo sapiens [sequence omitted]

SEQ ID NO: 399 - protein, 561 aa, Homo sapiens
MGMPPLLFCWVSFVLPLFVAAGNCTDVYMHHEMISEGQPFPFNCTYPPVTNGAVNLTWHRTPSKSPISINRHVRIHQDQSWILFLPLALEDSGIYQCVIKDAHSCYRIAINLTVFRKHWCDSSNEESSINSSDEYQQWLPIGKSGSLTCHLYFPESCVLDSIKWYKGCEEIKVSKKFCPTGTKLLVNNIDVEDSGSYACSARLTHLGRIFTVRNYIAVNTKEVGSGGRIPNITYPKNNSIEVQLGSTLIVDCNITDTKENTNLRCWRVNNTLVDDYYNDFKRIQEGIETNLSLRNHILYTVNITFLEVKMEDYGHPFTCHAAVSAAYIILKRPAPDFRAYLIGGLMAFLLLAVSILYIYNTFKVDIVLWYRSTFHTAQAPDDEKLYDAYVLYPKYPRESQGHDVDTLVLKILPEVLEKQCGYKLFIFGRDEFPGQAVASVIDENIKLCRRLMVLVAPETSSFSFLKNLTEEQIAVYNALVQDGMKVILIELERVKDYSTMPESIQYIRQKHGAIQWDGDFTEQAQCAKTKFWKKVRYHMPPRRYPASPPVQLLGHTPRIPG

SEQ ID NO: 400 - protein, 380 aa, Homo sapiens; identical to SEQ ID NO: 299

SEQ ID NO: 401 - protein, 137 aa, Homo sapiens
MKVSVAALSCLMLVTALGSQARVTKDAETEFMMSKLPLENPVLLDMLWRRKIGPQMTLSHAAGFHATSADCCISYTPRSIPCSLLESYFETNSECSKPGVIFLTKKGRRFCANPSDKQVQVCMRMLKLDTRIKTRKN

SEQ ID NO: 402 - protein, 101 aa, Homo sapiens
MSSAAGFCASRPGLLFLGLLLLPLVVAFASAEAEEDGDLQCLCVKTTSQVRPRHITSLEVIKAGPHCPTAQLIATLKKGRKACLNPASPIVKKIIKKLLES

SEQ ID NO: 403 - protein, 73 aa, Homo sapiens
MSAKDLQCQCIKTYSKPFHPKFIKELRVIESGPHCANTEIIVKLSDGRELCLDPKENWVQRVVEKFLKRAENS

SEQ ID NO: 404 - protein, 73 aa, Homo sapiens
MSAKELQCQCIKTYSKPFHPKFIKELRVIESGPHCANTEIIVKLSDGRELCLDPKENWVQRVVEKFLKRAENS

SEQ ID NO: 405 - protein, 98 aa, Homo sapiens; identical to SEQ ID NO: 249

SEQ ID NO: 406 - protein, 120 aa, Homo sapiens
MKVSEAALSLLVLILIITSASRSQPKVPEWVNTPSTCCLKYYEKVLPRRLVVGYRKALNCHLPAIIFVTKRNREVCTNPNDDWVQEYIKDPNLPLLPTRNLSTVKIITAKNGQPQLLNSQ

SEQ ID NO: 407 - protein, 96 aa, Homo sapiens; identical to SEQ ID NO: 248

SEQ ID NO: 408 - protein, 93 aa, Homo sapiens; identical to SEQ ID NO: 343

SEQ ID NO: 409 - protein, 109 aa, Homo sapiens
MKFISTSLLLMLLVSSLSPVQGVLEVYYTSLRCRCVQESSVFIPRRFIDRIQILPRGNGCPRKEIIVWKKNKSIVCVDPQAEWIQRMMEVLRKRSSSTLPVPVFKRKIP

SEQ ID NO: 410 - protein, 93 aa, Homo sapiens
MGLSLASAVLLASLLSLHLGTATRGSDISKTCCFQYLGTATRGSDISKTCCFQYSCSQRAVIFTTKRGKKVCTHPRKKWVQKYISLLKTPKQL

SEQ ID NO: 411 - protein, 111 aa, Homo sapiens
MAPISLSWLLRLATFCHLTVLLAGQHHGVTKCNITCSKMTSKIPVALLIHYQQNQASCGKRAIILETRQHRLFCADPKEQWVKDAMQHLDRQAAALTPKWRHLPKKPDRRG

SEQ ID NO: 412 - protein, 113 aa, Homo sapiens; identical to SEQ ID NO: 342

SEQ ID NO: 413 - protein, 150 aa, Homo sapiens [sequence omitted]

SEQ ID NO: 414 - protein, 120 aa, Homo sapiens; identical to SEQ ID NO: 406

SEQ ID NO: 415 - protein, 95 aa, Homo sapiens
MSVKGMAIALAVILCATVVQGFPMFKRGRCLCIGPGVKAVKVADIEKASIMYPSNNCDKIEVIITLKEIRKRCLTPNRASKQARLIIKKAERKNF

SEQ ID NO: 416 - protein, 127 aa, Homo sapiens
MQQRGLAIVALAVCAALHASEAILPIASSCCTEVSHHISRRLLERVNMCRIQRADGDCDLAAVILHVKRRRICVSPHNHTVKQWMKVQAAKKNGKGNVCHRKKHHGKRNSNRAHQGKHETYGHKTPY

SEQ ID NO: 417 - protein, 112 aa, Homo sapiens
MKGPPTFCSLLLLSLLLSPDPTAAFLLPPSTACCTQLYRKPLSDKLLRKVIQVELQEADGDCHLQAFVLHLAQRSICIHPQNPSLSQWFEHQERKLHGTLPKLNFGMLRKMG

SEQ ID NO: 418 - protein, 42 aa, Homo sapiens
RFEGYRPNLAESCPCRQYRAYVLTHSGELYERPERSDRQICV

SEQ ID NO: 419 - protein, 134 aa, Homo sapiens; identical to SEQ ID NO: 246

SEQ ID NO: 420 - protein, 93 aa, Homo sapiens
MARLQTALLVVLVLLAVALQATEAGPYGANMEDSVCCRDYVRYRLPLRVVKHFYWTSDSCPRPGVVLLTFRDKEICADPRVPWVKMILNKLSQ

SEQ ID NO: 421 - protein, 109 aa, Homo sapiens; identical to SEQ ID NO: 409

SEQ ID NO: 422 - protein, 93 aa, Homo sapiens; identical to SEQ ID NO: 420

SEQ ID NO: 423 - protein, 127 aa, Homo sapiens
  MOD_RES (70)..(70): Any naturally occurring amino acid
  MOD_RES (91)..(91): Any naturally occurring amino acid
MQQRGLAIVALAVCAALHASEAILPIASSCCTEVSHHISRRLLERVNMCRIQRADGDCDLAAVILHVKRXRICVSPHNHTVKQWMKVQAAXKNGKGNVCHRKKHHGKRNSNRAHQGKHETYGHKTPY

SEQ ID NO: 424 - protein, 104 aa, Homo sapiens
  MOD_RES (47)..(47): Any naturally occurring amino acid
  MOD_RES (68)..(68): Any naturally occurring amino acid
LPIASSCCTEVSHHISRRLLERVNMCRIQRADGDCDLAAVILHVKRXRICVSPHNHTVKQWMKVQAAXKNGKGNVCHRKKHHGKRNSNRAHQGKHETYGHKTPY

SEQ ID NO: 425 - protein, 69 aa, Homo sapiens
MKPVSLSYRCPCRFFESHVARANVKHLKILNTPNCALQIVARLKNNNRQVCIDPKLKWIQEYLEKALNK

SEQ ID NO: 426 - protein, 73 aa, Homo sapiens
MKPVSLSYRCPCRFFESHVARANVKHLKILNTPNCALQIVARLKNNNRQVCIDPKLKWIQEYLEKALNKRFKM

SEQ ID NO: 427 - protein, 90 aa, Homo sapiens
MAAKDVKHHHHHHGSGSDDDDKKPVSLSYRCPCRFFESHVARANVKHLKILNTPNCALQIVARLKNNNRQVCIDPKLKWIQEYLEKALNK

SEQ ID NO: 428 - protein, 94 aa, Homo sapiens
MAAKDVKHHHHHHGSGSDDDDKKPVSLSYRCPCRFFESHVARANVKHLKILNTPNCALQIVARLKNNNRQVCIDPKLKWIQEYLEKALNKRFKM

SEQ ID NO: 429 - protein, 71 aa, Homo sapiens
SIPITCCFNVINRKIPIQRLESYTRITNIQCPKEAVIFKTKRGKEVCADPKERWVRDSMKHLDQIFQNLKP

SEQ ID NO: 430 - protein, 66 aa, Homo sapiens
YSSDTTPCCFAYIARPLPRAHIKEYFYTSGKCSNPAVVFVTRKNRQVCANPEKKWVREYINSLEMS

SEQ ID NO: 431 - protein, 356 aa, Homo sapiens
MSIPLPLLQIYTSDNYTEEMGSGDYDSMKEPCFREENANFNKIFLPTIYSIIFLTGIVGNGLVILVMGYQKKLRSMTDKYRLHLSVADLLFVITLPFWAVDAVANWYFGNFLCKAVHVIYTVNLYSSVLILAFISLDRYLAIVHATNSQRPRKLLAEKVVYVGVWIPALLLTIPDFIFANVSEADDRYICDRFYPNDLWVVVFQFQHIMVGLILPGIVILSCYCIIISKLSHSKGHQKRKALKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSS

SEQ ID NO: 432 - protein, 94 aa, Homo sapiens; identical to SEQ ID NO: 349

SEQ ID NO: 433 - protein, 93 aa, Homo sapiens; identical to SEQ ID NO: 381

SEQ ID NO: 434 - protein, 92 aa, Homo sapiens; identical to SEQ ID NO: 364

SEQ ID NO: 435 - protein, 109 aa, Homo sapiens
MKISVAAIPFFLLITIALGTKTESSSQTGGKPKVVKIQLKLVGGPYHPSECCFTYTTYKIPRQRIMDYYETNSQCSKPGIVFITKRGHSVCTNPSDKWVQDYIKDMKEN

SEQ ID NO: 436 - protein, 134 aa, Homo sapiens; identical to SEQ ID NO: 246

SEQ ID NO: 437 - protein, 145 aa, Homo sapiens
MAQSLALSLLILVLAFGIPRTQGSDGGAQDCCLKYSQRKIPAKVVRSYRKQEPSLGCSIPAILFLPRKRSQAELCADPKELWVQQLMQHLDKTPSPQKPAQGCRKDRGASKTGKKGKGSKGCKSQPLTPLFCPHRTERSQTPKGP

SEQ ID NO: 438 - protein, 93 aa, Homo sapiens; identical to SEQ ID NO: 381

SEQ ID NO: 439 - protein, 89 aa, Homo sapiens
MKGLAAALLVLVCTMALCSCAQVGTNKELCCLVYTSWQIPQKFIVDYSETSPQCPKPGVILLTKRGRQICADPNKKWVQKYISDLKLNA

SEQ ID NO: 440 - protein, 69 aa, Homo sapiens
AQVGTNKELCCLVYTSWQIPQKFIVDYSETSPQCPKPGVILLTKRGRQICADPNKKWVQKYISDLKLNA

SEQ ID NO: 441 - protein, 264 aa, Homo sapiens
MKKTAIAIAVALAGFATVANADEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQCLAARLEALKENGGARLAEYHAKATEHLSTLSEKAKPALEDLRQGLLPVLESFKVSFLSALEEYTKKLNTQ

SEQ ID NO: 442 - protein, 687 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRGEHCNKKAVFSRISKFKSTRNDCTTQSNVKH

SEQ ID NO: 443 - protein, 668 aa, Homo sapiens
SEQNMQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIAVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLER

SEQ ID NO: 444 - protein, 780 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLELITLTCTCVAATLFWLLLTLLI

SEQ ID NO: 445 - protein, 788 aa, Homo sapiens
MQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIAVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSGIVLKDGNRNLTIRRVRKEDEGLYCQACSVLGCAKVEAFFIIEGAQEKTNLEIIILVGTTVIAMFFWLLLVIILGTV

SEQ ID NO: 446 - protein, 374 aa, Homo sapiens; identical to SEQ ID NO: 362

SEQ ID NO: 447 - protein, 360 aa, Homo sapiens
MLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYHIGYFGGIFFIILLTIDRYLAIVHAVFALKARTVTFGVVTSVITWLVAVFASVPGIIFTKCQKEDSVYVCGPYFPRGWNNFHTIMRNILGLVLPLLIMVICYSGILKTLLRCRNEKKRHRAVRVIFTIMIVYFLFWTPYNIVILLNTFQEFFGLSNCESTSQLDQATQVTETLGMTHCCINPIIYAFVGEKFRRYLSVFFRKHITKRFCKQCPVFYRETVDGVTSTNTPSTGEQEVSAGL

SEQ ID NO: 448 - protein, 352 aa, Homo sapiens [sequence omitted]

SEQ ID NO: 449 - protein, 152 aa, Homo sapiens; identical to SEQ ID NO: 280

SEQ ID NO: 450 - protein, 195 aa, Homo sapiens
DSQGVLSSFPAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKD

SEQ ID NO: 451 - protein, 178 aa, Homo sapiens
  MOD_RES (1)..(1): Asp or Asn
XPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKD

SEQ ID NO: 452 - protein, 86 aa, Homo sapiens
AIKKAHIEKDFIAFCSSTPDNVSWRHPTMGSVFIGRLIEHMQEYACSCDVEEIFRKVRFSFEQPGRAQMPTTERVTTRCFYLFPGH

SEQ ID NO: 453 - protein, 267 aa, Homo sapiens; identical to SEQ ID NO: 313

SEQ ID NO: 454 - protein, 208 aa, Homo sapiens
MTHLSLLGPLPCVRTSQQLPETQQVTTPGKKPVSVGRREVRVPGTALVPSLLSVSVSPAAPQYQGSPFSDPGFSAPELQLSSLPPATAFFKTWHALDDGERLSPRGPLTQHLQLVEDDQSDLNPGSPILPAQLGAARLRAQGPLGNMAAIMTALGLPIPPEEDTPGLAAFGASAFERKCRGYVVTREYGHWTDRAVRDLALLKAKYSA

SEQ ID NO: 455 - protein, 208 aa, Homo sapiens [sequence omitted]

SEQ ID NO: 456 - protein, 109 aa, Homo sapiens
MLKLTPLPSKMKVSAALLCLLLMAATFSPQGLAQPDSVSIPITCCFNVINRKIPIQRLESYTRITNIQCPKEAVIFKTKRGKEVCADPKERWVRDSMKHLDQIFQNLKP

SEQ ID NO: 457 - protein, 122 aa, Homo sapiens
MKPFHTALSFLILTTALGIWAQITHATETKEVQSSLKAQQGLEIEMFHMGFQDSSDCCLSYNSRIQCSRFIGYFPTSGGCTRPGIIFISKRGFQVCANPSDRRVQRCIERLEQNSQPRTYKQ

SEQ ID NO: 458 - protein, 131 aa, Homo sapiens
MARSLVCLGVIILLSAFSGPGVRGGPMPKLADRKLCADQECSHPISMAVALQDYMAPDCRFLTIHRGQVVYVFSKLKGRGRLFWGGSVQGDYYGDLAARLGYFPSSIVREDQTLKPGKVDVKTDKWDFYCQ

SEQ ID NO: 459 - protein, 120 aa, Homo sapiens
MKVSVAALSCLMLVTALGSQARVTKDAETEFMMSKLPLENPVLLDRFHATSADCCISYTPRSIPCSLLESYFETNSECSKPGVIFLTKKGRRFCANPSDKQVQVCVRMLKLDTRIKTRKN

SEQ ID NO: 460 - protein, 114 aa, Homo sapiens
MRLLILALLGICSLTAYIVEGVGSEVSHRRTCVSLTTQRLPVSRIKTYTITEGSLRAVIFITKRGLKVCADPQATWVRDVVRSMDRKSNTRNNMIQTKPTGTQQSTNTAVTLTG

SEQ ID NO: 461 - protein, 1255 aa, Homo sapiens
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 462 - protein, 478 aa, Human immunodeficiency virus
KLWVTVYYGVPVWKEATTTLFCASDARAYDTEVHNVWATHACVPTDPNPQEVVLGNVTENFNMWKNNMVEQMQEDIISLWDQSLKPCVKLTPLCVTLNCTDLGKATNTNSSNWKEEIKGEIKNCSFNITTSIRDKIQKENALFRNLDVVPIDNASTTTNYTNYRLIHCNRSVITQACPKVSFEPIPIHYCTPAGFAILKCNNKTFNGKGPCTNVSTVQCTHGIRPIVSTQLLLNGSLAEEEVVIRSDNFTNNAKTIIVQLNESVAINCTRPNNNTRKSIYIGPGRAFHTTGRIIGDIRKAHCNISRAQWNNTLEQIVKKLREQFGNNKTIVFNQSSGGDPEIVMHSFNCRGEFFYCNTTQLFNNTWRLNHTEGTKGNDTIILPCRIKQIINMWQEVGKAMYAPPIGGQISCSSNITGLLLTRDGGTNVTNDTEVFRPGGGDMRDNWRSELYKYKVIKIEPLGIAPTKAKRRVVQREKR

SEQ ID NO: 463 - protein, 94 aa, Homo sapiens; identical to SEQ ID NO: 363

SEQ ID NO: 464 - protein, 477 aa, Homo sapiens
LEHDNPEDDKVYFFFRENAIDGEHSGKATHARIGQICKNDFGGHRSLVNKWTTFLKARLICSVPGPNGIDTHFDELQDVFLMNFKDPKNPVVYGVFTTSSNIFKGSAVCMYSMSDVRRVFLGPYAHRDGPNYQWVPYQGRVPYPRPGTCPSKTFGGFDSTKDLPDDVITFARSHPAMYNPVFPMNNRPIVIKTDVNYQFTQIVVDRVDAEDGQYDVMFIGTDVGTVLKVVSIPKETWYDLEEVLLEEMTVFREPTAISAMELSTKQQQLYIGSTAGVAQLPLHRCDIYGKACAECCLARDPYCAWDGSACSRYFPTAKRRTRRQDIRNGDPLTHCSDLHHDNHHGHSPEERIIYGVENSSTFLECSPKSQRALVYWQFQRRNEERKEEIRVDDHIIRTDQGLLLRSLQQKDSGNYLCHAVEHGFIQTLLKVTLEVIDNEHLEELLHKDDDGHGSKTKEMSNSMTPSQKVWYRDFMQP

SEQ ID NO: 465 - protein, 241 aa, Homo sapiens; identical to SEQ ID NO: 254

SEQ ID NO: 466 - protein, 267 aa, Homo sapiens
MKAAVLTLAVLFLTGSQARHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 467 - DNA, 20 bp, Artificial Sequence
  Synthetic oligonucleotide
tgagcagaagtggctcagtg

SEQ ID NO: 468 - DNA, 20 bp, Artificial Sequence
  Synthetic oligonucleotide
tggctgtacagctacacccc

SEQ ID NO: 469 - DNA, 20 bp, Artificial Sequence
  Synthetic oligonucleotide
ttccactcctgcagggcccc

SEQ ID NO: 470 - DNA, 20 bp, Artificial Sequence
  Synthetic oligonucleotide
tcgcccttcagcccgcgttc

SEQ ID NO: 471 - protein, 7 aa, Homo sapiens
PKKKRKV

SEQ ID NO: 472 - protein, 16 aa, Homo sapiens
LGRVIPRKIASRASLM

SEQ ID NO: 473-485 - skipped (13 entries)

SEQ ID NO: 486 - protein, 786 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGAAGAGVLGGLVPGPQAAVPGVPGTGGVPGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAGADEGVRRSLSPELREGDPSSSQHLPSTPSSPRVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 487 - protein, 1464 aa, Homo sapiens
MFSFVDLRLLLLLAATALLTHGQEEGQVEGQDEDIPPITCVQNGLRYHDRDVWKPEPCRICVCDNGKVLCDDVICDETKNCPGAEVPEGECCPVCPDGSESPTDQETTGVEGPKGDTGPRGPRGPAGPPGRDGIPGQPGLPGPPGPPGPPGPPGLGGNFAPQLSYGYDEKSTGGISVPGPMGPSGPRGLPGPPGAPGPQGFQGPPGEPGEPGASGPMGPRGPPGPPGKNGDDGEAGKPGRPGERGPPGPQGARGLPGTAGLPGMKGHRGFSGLDGAKGDAGPAGPKGEPGSPGENGAPGQMGPRGLPGERGRPGAPGPAGARGNDGATGAAGPPGPTGPAGPPGFPGAVGAKGEAGPQGPRGSEGPQGVRGEPGPPGPAGAAGPAGNPGADGQPGAKGANGAPGIAGAPGFPGARGPSGPQGPGGPPGPKGNSGEPGAPGSKGDTGAKGEPGPVGVQGPPGPAGEEGKRGARGEPGPTGLPGPPGERGGPGSRGFPGADGVAGPKGPAGERGSPGPAGPKGSPGEAGRPGEAGLPGAKGLTGSPGSPGPDGKTGPPGPAGQDGRPGPPGPPGARGQAGVMGFPGPKGAAGEPGKAGERGVPGPPGAVGPAGKDGEAGAQGPPGPAGPAGERGEQGPAGSPGFQGLPGPAGPPGEAGKPGEQGVPGDLGAPGPSGARGERGFPGERGVQGPPGPAGPRGANGAPGNDGAKGDAGAPGAPGSQGAPGLQGMPGERGAAGLPGPKGDRGDAGPKGADGSPGKDGVRGLTGPIGPPGPAGAPGDKGESGPSGPAGPTGARGAPGDRGEPGPPGPAGFAGPPGADGQPGAKGEPGDAGAKGDAGPPGPAGPAGPPGPIGNVGAPGAKGARGSAGPPGATGFPGAAGRVGPPGPSGNAGPPGPPGPAGKEGGKGPRGETGPAGRPGEVGPPGPPGPAGEKGSPGADGPAGAPGTPGPQGIAGQRGVVGLPGQRGERGFPGLPGPSGEPGKQGPSGASGERGPPGPMGPPGLAGPPGESGREGAPGAEGSPGRDGSPGAKGDRGETGPAGPPGAPGAPGAPGPVGPAGKSGDRGETGPAGPTGPVGPVGARGPAGPQGPRGDKGETGEQGDRGIKGHRGFSGLQGPPGPPGSPGEQGPSGASGPAGPRGPPGSAGAPGKDGLNGLPGPIGPPGPRGRTGDAGPVGPPGPPGPPGPPGPPSAGFDFSFLPQPPQEKAHDGGRYYRADDANVVRDRDLEVDTTLKSLSQQIENIRSPEGSRKNPARTCRDLKMCHSDWKSGEYWIDPNQGCNLDAIKVFCNMETGETCVYPTQPSVAQKNWYISKNPKDKRHVWFGESMTDGFQFEYGGQGSDPADVAIQLTFLRLMSTEASQNITYHCKNSVAYMDQQTGNLKKALLLQGSNEIEIRAEGNSRFTYSVTVDGCTSHTGAWGKTVIEYKTTKTSRLPIIDVAPLDVGAPDQEFGFDVGPVCFL

SEQ ID NO: 488 - protein, 1366 aa, Homo sapiens
MLSFVDTRTLLLLAVTLCLATCQSLQEETVRKGPAGDRGPRGERGPPGPPGRDGEDGPTGPPGPPGPPGPPGLGGNFAAQYDGKGVGLGPGPMGLMGPRGPPGAAGAPGPQGFQGPAGEPGEPGQTGPAGARGPAGPPGKAGEDGHPGKPGRPGERGVVGPQGARGFPGTPGLPGFKGIRGHNGLDGLKGQPGAPGVKGEPGAPGENGTPGQTGARGLPGERGRVGAPGPAGARGSDGSVGPVGPAGPIGSAGPPGFPGAPGPKGEIGAVGNAGPAGPAGPRGEVGLPGLSGPVGPPGNPGANGLTGAKGAAGLPGVAGAPGLPGPRGIPGPVGAAGATGARGLVGEPGPAGSKGESGNKGEPGSAGPQGPPGPSGEEGKRGPNGEAGSAGPPGPPGLRGSPGSRGLPGADGRAGVMGPPGSRGASGPAGVRGPNGDAGRPGEPGLMGPRGLPGSPGNIGPAGKEGPVGLPGIDGRPGPIGPAGARGEPGNIGFPGPKGPTGDPGKNGDKGHAGLAGARGAPGPDGNNGAQGPPGPQGVQGGKGEQGPPGPPGFQGLPGPSGPAGEVGKPGERGLHGEFGLPGPAGPRGERGPPGESGAAGPTGPIGSRGPSGPPGPDGNKGEPGVVGAVGTAGPSGPSGLPGERGAAGIPGGKGEKGEPGLRGEIGNPGRDGARGAPGAVGAPGPAGATGDRGEAGAAGPAGPAGPRGSPGERGEVGPAGPNGFAGPAGAAGQPGAKGERGAKGPKGENGVVGPTGPVGAAGPAGPNGPPGPAGSRGDGGPPGMTGFPGAAGRTGPPGPSGISGPPGPPGPAGKEGLRGPRGDQGPVGRTGEVGAVGPPGFAGEKGPSGEAGTAGPPGTPGPQGLLGAPGILGLPGSRGERGLPGVAGAVGEPGPLGIAGPPGARGPPGAVGSPGVNGAPGEAGRDGNPGNDGPPGRDGQPGHKGERGYPGNIGPVGAAGAPGPHGPVGPAGKHGNRGETGPSGPVGPAGAVGPRGPSGPQGIRGDKGEPGEKGPRGLPGLKGHNGLQGLPGIAGHHGDQGAPGSVGPAGPRGPAGPSGPAGKDGRTGHPGTVGPAGIRGPQGHQGPAGPPGPPGPPGPPGVSGGGYDFGYDGDFYRADQPRSAPSLRPKDYEVDATLKSLNNQIETLLTPEGSRKNPARTCRDLRLSHPEWSSGYYWIDPNQGCTMDAIKVYCDFSTGETCIRAQPENIPAKNWYRSSKDKKHVWLGETINAGSQFEYNVEGVTSKEMATQLAFMRLLANYASQNITYHCKNSIAYMDEETGNLKKAVILQGSNDVELVAEGNSRFTYTVLVDGCSKKTNEWGKTIIEYKTNKPSRLPFLDIAPLDIGGADQEFFVDIGPVCFK

SEQ ID NO: 489 - protein, 1466 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGAQGPPGAPGPLGIAGITGARGLAGPPGMPGPRGSPGPQGVKGESGKPGANGLSGERGPPGPQGLPGLAGTAGEPGRDGNPGSDGLPGRDGSPGGKGDRGENGSPGAPGAPGHPGPPGPVGPAGKSGDRGESGPAGPAGAPGPAGSRGAPGPQGPRGDKGETGERGAAGIKGHRGFPGNPGAPGSPGPAGQQGAIGSPGPAGPRGPVGPSGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSVNGQIESLISPDGSRKNPARNCRDLKFCHPELKSGEYWVDPNQGCKLDAIKVFCNMETGETCISANPLNVPRKHWWTDSSAEKKHVWFGESMDGGFQFSYGNPELPEDVLDVHLAFLRLLSSRASQNITYHCKNSIAYMDQASGNVKKALKLMGSNEGEFKAEGNSKFTYTVLEDGCTKHTGEWSKTVFEYRTRKAVRLPIVDIAPYDIGGPDQEFGVDVGPVCFL

SEQ ID NO: 490 - protein, 2944 aa, Homo sapiens
MTLRLLVAALCAGILAEAPRVRAQHRERVTCTRLYAADIVFLLDGSSSIGRSNFREVRSFLEGLVLPFSGAASAQGVRFATVQYSDDPRTEFGLDALGSGGDVIRAIRELSYKGGNTRTGAAILHVADHVFLPQLARPGVPKVCILITDGKSQDLVDTAAQRLKGQGVKLFAVGIKNADPEELKRVASQPTSDFFFFVNDFSILRTLLPLVSRRVCTTAGGVPVTRPPDDSTSAPRDLVLSEPSSQSLRVQWTAASGPVTGYKVQYTPLTGLGQPLPSERQEVNVPAGETSVRLRGLRPLTEYQVTVIALYANSIGEAVSGTARTTALEGPELTIQNTTAHSLLVAWRSVPGATGYRVTWRVLSGGPTQQQELGPGQGSVLLRDLEPGTDYEVTVSTLFGRSVGPATSLMARTDASVEQTLRPVILGPTSILLSWNLVPEARGYRLEWRRETGLEPPQKVVLPSDVTRYQLDGLQPGTEYRLTLYTLLEGHEVATPATVVPTGPELPVSPVTDLQATELPGQRVRVSWSPVPGATQYRIIVRSTQGVERTLVLPGSQTAFDLDDVQAGLSYTVRVSARVGPREGSASVLTVRREPETPLAVPGLRVVVSDATRVRVAWGPVPGASGFRISWSTGSGPESSQTLPPDSTATDITGLQPGTTYQVAVSVLRGREEGPAAVIVARTDPLGPVRTVHVTQASSSSVTITWTRVPGATGYRVSWHSAHGPEKSQLVSGEATVAELDGLEPDTEYTVHVRAHVAGVDGPPASVVVRTAPEPVGRVSRLQILNASSDVLRITWVGVTGATAYRLAWGRSEGGPMRHQILPGNTDSAEIRGLEGGVSYSVRVTALVGDREGTPVSIVVTTPPEAPPALGTLHVVQRGEHSLRLRWEPVPRAQGFLLHWQPEGGQEQSRVLGPELSSYHLDGLEPATQYRVRLSVLGPAGEGPSAEVTARTESPRVPSIELRVVDTSIDSVTLAWTPVSRASSYILSWRPLRGPGQEVPGSPQTLPGISSSQRVTGLEPGVSYIFSLTPVLDGVRGPEASVTQTPVCPRGLADVVFLPHATQDNAHRAEATRRVLERLVLALGPLGPQAVQVGLLSYSHRPSPLFPLNGSHDLGIILQRIRDMPYMDPSGNNLGTAVVTAHRYMLAPDAPGRRQHVPGVMVLLVDEPLRGDIFSPIREAQASGLNVVMLGMAGADPEQLRRLAPGMDSVQTFFAVDDGPSLDQAVSGLATALCQASFTTQPRPEPCPVYCPKGQKGEPGEMGLRGQVGPPGDPGLPGRTGAPGPQGPPGSATAKGERGFPGADGRPGSPGRAGNPGTPGAPGLKGSPGLPGPRGDPGERGPRGPKGEPGAPGQVIGGEGPGLPGRKGDPGPSGPPGPRGPLGDPGPRGPPGLPGTAMKGDKGDRGERGPPGPGEGGIAPGEPGLPGLPGSPGPQGPVGPPGKKGEKGDSEDGAPGLPGQPGSPGEQGPRGPPGAIGPKGDRGFPGPLGEAGEKGERGPPGPAGSRGLPGVAGRPGAKGPEGPPGPTGRQGEKGEPGRPGDPAVVGPAVAGPKGEKGDVGPAGPRGATGVQGERGPPGLVLPGDPGPKGDPGDRGPIGLTGRAGPPGDSGPPGEKGDPGRPGPPGPVGPRGRDGEVGEKGDEGPPGDPGLPGKAGERGLRGAPGVRGPVGEKGDQGDPGEDGRNGSPGSSGPKGDRGEPGPPGPPGRLVDTGPGAREKGEPGDRGQEGPRGPKGDPGLPGAPGERGIEGFRGPPGPQGDPGVRGPAGEKGDRGPPGLDGRSGLDGKPGAAGPSGPNGAAGKAGDPGRDGLPGLRGEQGLPGPSGPPGLPGKPGEDGKPGLNGKNGEPGDPGEDGRKGEKGDSGASGREGRDGPKGERGAPGILGPQGPPGLPGPVGPPGQGFPGVPGGTGPKGDRGETGSKGEQGLPGERGLRGEPGSVPNVDRLLETAGIKASALREIVETWDESSGSFLPVPERRRGPKGDSGEQGPPGKEGPIGFPGERGLKGDRGDPGPQGPPGLALGERGPPGPSGLAGEPGKPGIPGLPGRAGGVGEAGRPGERGERGEKGERGEQGRDGPPGLPGTPGPPGPPGPKVSVDEPGPGLSGEQGPPGLKGAKGEPGSNGDQGPKGDRGVPGIKGDRGEPGPRGQDGNPGLPGERGMAGPEGKPGLQGPRGPPGPVGGHGDPGPPGAPGLAGPAGPQGPSGLKGEPGETGPPGRGLTGPTGAVGLPGPPGPSGLVGPQGSPGLPGQVGETGKPGAPGRDGASGKDGDRGSPGVPGSPGLPGPVGPKGEPGPTGAPGQAVVGLPGAKGEKGAPGGLAGDLVGEPGAKGDRGLPGPRGEKGEAGRAGEPGDPGEDGQKGAPGPKGFKGDPGVGVPGSPGPPGPPGVKGDLGLPGLPGAPGVVGFPGQTGPRGEMGQPGPSGERGLAGPPGREGIPGPLGPPGPPGSVGPPGASGLKGDKGDPGVGLPGPRGERGEPGIRGEDGRPGQEGPRGLTGPPGSRGERGEKGDVGSAGLKGDKGDSAVILGPPGPRGAKGDMGERGPRGLDGDKGPRGDNGDPGDKGSKGEPGDKGSAGLPGLRGLLGPQGQPGAAGIPGDPGSPGKDGVPGIRGEKGDVGFMGPRGLKGERGVKGACGLDGEKGDKGEAGPPGRPGLAGHKGEMGEPGVPGQSGAPGKEGLIGPKGDRGFDGQPGPKGDQGEKGERGTPGIGGFPGPSGNDGSAGPPGPPGSVGPRGPEGLQGQKGERGPPGERVVGAPGVPGAPGERGEQGRPGPAGPRGEKGEAALTEDDIRGFVRQEMSQHCACQGQFIASGSRPLPSYAADTAGSQLHAVPVLRVSHAEEEERVPPEDDEYSEYSEYSVEEYQDPEAPWDSDDPCSLPLDEGSCTAYTLRWYHRAVTGSTEACHPFVYGGCGGNANRFGTREACERRCPPRVVQSQGTGTAQD

SEQ ID NO: 491 - protein, 529 aa, Homo sapiens [sequence omitted]

SEQ ID NO: 492 - protein, 1669 aa, Homo sapiens
MGPRLSVWLLLLPAALLLHEEHSRAAAKGGCAGSGCGKCDCHGVKGQKGERGLPGLQGVIGFPGMQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEKGQMGLSFQGPKGDKGDQGVSGPPGVPGQAQVQEKGDFATKGEKGQKGEPGFQGMPGVGEKGEPGKPGPRGKPGKDGDKGEKGSPGFPGEPGYPGLIGRQGPQGEKGEAGPPGPPGIVIGTGPLGEKGERGYPGTPGPRGEPGPKGFPGLPGQPGPPGLPVPGQAGAPGFPGERGEKGDRGFPGTSLPGPSGRDGLPGPPGSPGPPGQPGYTNGIVECQPGPPGDQGPPGIPGQPGFIGEIGEKGQKGESCLICDIDGYRGPPGPQGPPGEIGFPGQPGAKGDRGLPGRDGVAGVPGPQGTPGLIGQPGAKGEPGEFYFDLRLKGDKGDPGFPGQPGMTGRAGSPGRDGHPGLPGPKGSPGSVGLKGERGPPGGVGFPGSRGDTGPPGPPGYGPAGPIGDKGQAGFPGGPGSPGLPGPKGEPGKIVPLPGPPGAEGLPGSPGFPGPQGDRGFPGTPGRPGLPGEKGAVGQPGIGFPGPPGPKGVDGLPGDMGPPGTPGRPGFNGLPGNPGVQGQKGEPGVGLPGLKGLPGLPGIPGTPGEKGSIGVPGVPGEHGAIGPPGLQGIRGEPGPPGLPGSVGSPGVPGIGPPGARGPPGGQGPPGLSGPPGIKGEKGFPGFPGLDMPGPKGDKGAQGLPGITGQSGLPGLPGQQGAPGIPGFPGSKGEMGVMGTPGQPGSPGPVGAPGLPGEKGDHGFPGSSGPRGDPGLKGDKGDVGLPGKPGSMDKVDMGSMKGQKGDQGEKGQIGPIGEKGSRGDPGTPGVPGKDGQAGQPGQPGPKGDPGISGTPGAPGLPGPKGSVGGMGLPGTPGEKGVPGIPGPQGSPGLPGDKGAKGEKGQAGPPGIGIPGLRGEKGDQGIAGFPGSPGEKGEKGSIGIPGMPGSPGLKGSPGSVGYPGSPGLPGEKGDKGLPGLDGIPGVKGEAGLPGTPGPTGPAGQKGEPGSDGIPGSAGEKGEPGLPGRGFPGFPGAKGDKGSKGEVGFPGLAGSPGIPGSKGEQGFMGPPGPQGQPGLPGSPGHATEGPKGDRGPQGQPGLPGLPGPMGPPGLPGIDGVKGDKGNPGWPGAPGVPGPKGDPGFQGMPGIGGSPGITGSKGDMGPPGVPGFQGPKGLPGLQGIKGDQGDQGVPGAKGLPGPPGPPGPYDIIKGEPGLPGPEGPPGLKGLQGLPGPKGQQGVTGLVGIPGPPGIPGFDGAPGQKGEMGPAGPTGPRGFPGPPGPDGLPGSMGPPGTPSVDHGFLVTRHSQTIDDPQCPSGTKILYHGYSLLYVQGNERAHGQDLGTAGSCLRKFSTMPFLFCNINNVCNFASRNDYSYWLSTPEPMPMSMAPITGENIRPFISRCAVCEAPAMVMAVHSQTIQIPPCPSGWSSLWIGYSFVMHTSAGAEGSGQALASPGSCLEEFRSAPFIECHGRGTCNYYANAYSFWLATIERSEMFKKPTPSTLKAGELRTHVSRCQVCMRRT

SEQ ID NO: 493 - protein, 1712 aa, Homo sapiens
MGRDQRAVAGPALRRWLLLGTVTVGFLAQSVLAGVKKFDVPCGGRDCSGGCQCYPEKGGRGQPGPVGPQGYNGPPGLQGFPGLQGRKGDKGERGAPGVTGPKGDVGARGVSGFPGADGIPGHPGQGGPRGRPGYDGCNGTQGDSGPQGPPGSEGFTGPPGPQGPKGQKGEPYALPKEERDRYRGEPGEPGLVGFQGPPGRPGHVGQMGPVGAPGRPGPPGPPGPKGQQGNRGLGFYGVKGEKGDVGQPGPNGIPSDTLHPIIAPTGVTFHPDQYKGEKGSEGEPGIRGISLKGEEGIMGFPGLRGYPGLSGEKGSPGQKGSRGLDGYQGPDGPRGPKGEAGDPGPPGLPAYSPHPSLAKGARGDPGFPGAQGEPGSQGEPGDPGLPGPPGLSIGDGDQRRGLPGEMGPKGFIGDPGIPALYGGPPGPDGKRGPPGPPGLPGPPGPDGFLFGLKGAKGRAGFPGLPGSPGARGPKGWKGDAGECRCTEGDEAIKGLPGLPGPKGFAGINGEPGRKGDRGDPGQHGLPGFPGLKGVPGNIGAPGPKGAKGDSRTITTKGERGQPGVPGVPGMKGDDGSPGRDGLDGFPGLPGPPGDGIKGPPGDPGYPGIPGTKGTPGEMGPPGLGLPGLKGQRGFPGDAGLPGPPGFLGPPGPAGTPGQIDCDTDVKRAVGGDRQEAIQPGCIGGPKGLPGLPGPPGPTGAKGLRGIPGFAGADGGPGPRGLPGDAGREGFPGPPGFIGPRGSKGAVGLPGPDGSPGPIGLPGPDGPPGERGLPGEVLGAQPGPRGDAGVPGQPGLKGLPGDRGPPGFRGSQGMPGMPGLKGQPGLPGPSGQPGLYGPPGLHGFPGAPGQEGPLGLPGIPGREGLPGDRGDPGDTGAPGPVGMKGLSGDRGDAGFTGEQGHPGSPGFKGIDGMPGTPGLKGDRGSPGMDGFQGMPGLKGRPGFPGSKGEAGFFGIPGLKGLAGEPGFKGSRGDPGPPGPPPVILPGMKDIKGEKGDEGPMGLKGYLGAKGIQGMPGIPGLSGIPGLPGRPGHIKGVKGDIGVPGIPGLPGFPGVAGPPGITGFPGFIGSRGDKGAPGRAGLYGEIGATGDFGDIGDTINLPGRPGLKGERGTTGIPGLKGFFGEKGTEGDIGFPGITGVTGVQGPPGLKGQTGFPGLTGPPGSQGELGRIGLPGGKGDDGWPGAPGLPGFPGLRGIRGLHGLPGTKGFPGSPGSDIHGDPGFPGPPGERGDPGEANTLPGPVGVPGQKGDQGAPGERGPPGSPGLQGFPGITPPSNISGAPGDKGAPGIFGLKGYRGPPGPPGSAALPGSKGDTGNPGAPGTPGTKGWAGDSGPQGRPGVFGLPGEKGPRGEQGFMGNTGPTGAVGDRGPKGPKGDPGFPGAPGTVGAPGIAGIPQKIAVQPGTVGPQGRRGPPGAPGEMGPQGPPGEPGFRGAPGKAGPQGRGGVSAVPGFRGDEGPIGHQGPIGQEGAPGRPGSPGLPGMPGRSVSIGYLLVKHSQTDQEPMCPVGMNKLWSGYSLLYFEGQEKAHNQDLGLAGSCLARFSTMPFLYCNPGDVCYYASRNDKSYWLSTTAPLPMMPVAEDEIKPYISRCSVCEAPAIAIAVHSQDVSIPHCPAGWRSLWIGYSFLMHTAAGDEGGGQSLVSPGSCLEDFRATPFIECNGGRGTCHYYANKYSFWLTTIPEQSFQGSPSADTLKAGLIRTHISRCQVCMKNL

SEQ ID NO: 494 - protein, 1670 aa, Homo sapiens
MSARTAPRPQVLLLPLLLVLLAAAPAASKGCVCKDKGQCFCDGAKGEKGEKGFPGPPGSPGQKGFTGPEGLPGPQGPKGFPGLPGLTGSKGVRGISGLPGFSGSPGLPGTPGNTGPYGLVGVPGCSGSKGEQGFPGLPGTLGYPGIPGAAGLKGQKGAPAKEEDIELDAKGDPGLPGAPGPQGLPGPPGFPGPVGPPGPPGFFGFPGAMGPRGPKGHMGERVIGHKGERGVKGLTGPPGPPGTVIVTLTGPDNRTDLKGEKGDKGAMGEPGPPGPSGLPGESYGSEKGAPGDPGLQGKPGKDGVPGFPGSEGVKGNRGFPGLMGEDGIKGQKGDIGPPGFRGPTEYYDTYQEKGDEGTPGPPGPRGARGPQGPSGPPGVPGSPGSSRPGLRGAPGWPGLKGSKGERGRPGKDAMGTPGSPGCAGSPGLPGSPGPPGPPGDIVFRKGPPGDHGLPGYLGSPGIPGVDGPKGEPGLLCTQCPYIPGPPGLPGLPGLHGVKGIPGRQGAAGLKGSPGSPGNTGLPGFPGFPGAQGDPGLKGEKGETLQPEGQVGVPGDPGLRGQPGRKGLDGIPGTPGVKGLPGPKGELALSGEKGDQGPPGDPGSPGSPGPAGPAGPPGYGPQGEPGLQGTQGVPGAPGPPGEAGPRGELSVSTPVPGPPGPPGPPGHPGPQGPPGIPGSLGKCGDPGLPGPDGEPGIPGIGFPGPPGPKGDQGFPGTKGSLGCPGKMGEPGLPGKPGLPGAKGEPAVAMPGGPGTPGFPGERGNSGEHGEIGLPGLPGLPGTPGNEGLDGPRGDPGQPGPPGEQGPPGRCIEGPRGAQGLPGLNGLKGQQGRRGKTGPKGDPGIPGLDRSGFPGETGSPGIPGHQGEMGPLGQRGYPGNPGILGPPGEDGVIGMMGFPGAIGPPGPPGNPGTPGQRGSPGIPGVKGQRGTPGAKGEQGDKGNPGPSEISHVIGDKGEPGLKGFAGNPGEKGNRGVPGMPGLKGLKGLPGPAGPPGPRGDLGSTGNPGEPGLRGIPGSMGNMGMPGSKGKRGTLGFPGRAGRPGLPGIHGLQGDKGEPGYSEGTRPGPPGPTGDPGLPGDMGKKGEMGQPGPPGHLGPAGPEGAPGSPGSPGLPGKPGPHGDLGFKGIKGLLGPPGIRGPPGLPGFPGSPGPMGIRGDQGRDGIPGPAGEKGETGLLRAPPGPRGNPGAQGAKGDRGAPGFPGLPGRKGAMGDAGPRGPTGIEGFPGPPGLPGAIIPGQTGNRGPPGSRGSPGAPGPPGPPGSHVIGIKGDKGSMGHPGPKGPPGTAGDMGPPGRLGAPGTPGLPGPRGDPGFQGFPGVKGEKGNPGFLGSIGPPGPIGPKGPPGVRGDPGTLKIISLPGSPGPPGTPGEPGMQGEPGPPGPPGNLGPCGPRGKPGKDGKPGTPGPAGEKGNKGSKGEPGPAGSDGLPGLKGKRGDSGSPATWTTRGFVFTRHSQTTAIPSCPEGTVPLYSGFSFLFVQGNQRAHGQDLGTLGSCLQRFTTMPFLFCNVNDVCNFASRNDYSYWLSTPALMPMNMAPITGRALEPYISRCTVCEGPAIAIAVHSQTTDIPPCPHGWISLWKGFSFIMFTSAGSEGTGQALASPGSCLEEFRASPFLECHGRGTCNYYSNSYSFWLASLNPERMFRKPIPSTVKAGELEKIISRCQVCMKKRH

SEQ ID NO: 495 - protein, 1690 aa, Homo sapiens
MWSLHIVLMRCSFRLTKSLATGPWSLILILFSVQYVYGSGKKYIGPCGGRDCSVCHCVPEKGSRGPPGPPGPQGPIGPLGAPGPIGLSGEKGMRGDRGPPGAAGDKGDKGPTGVPGFPGLDGIPGHPGPPGPRGKPGMSGHNGSRGDPGFPGGRGALGPGGPLGHPGEKGEKGNSVFILGAVKGIQGDRGDPGLPGLPGSWGAGGPAGPTGYPGEPGLVGPPGQPGRPGLKGNPGVGVKGQMGDPGEVGQQGSPGPTLLVEPPDFCLYKGEKGIKGIPGMVGLPGPPGRKGESGIGAKGEKGIPGFPGPRGDPGSYGSPGFPGLKGELGLVGDPGLFGLIGPKGDPGNRGHPGPPGVLVTPPLPLKGPPGDPGFPGRYGETGDVGPPGPPGLLGRPGEACAGMIGPPGPQGFPGLPGLPGEAGIPGRPDSAPGKPGKPGSPGLPGAPGLQGLPGSSVIYCSVGNPGPQGIKGKVGPPGGRGPKGEKGNEGLCACEPGPMGPPGPPGLPGRQGSKGDLGLPGWLGTKGDPGPPGAEGPPGLPGKHGASGPPGNKGAKGDMVVSRVKGHKGERGPDGPPGFPGQPGSHGRDGHAGEKGDPGPPGDHEDATPGGKGFPGPLGPPGKAGPVGPPGLGFPGPPGERGHPGVPGHPGVRGPDGLKGQKGDTISCNVTYPGRHGPPGFDGPPGPKGFPGPQGAPGLSGSDGHKGRPGTPGTAEIPGPPGFRGDMGDPGFGGEKGSSPVGPPGPPGSPGVNGQKGIPGDPAFGHLGPPGKRGLSGVPGIKGPRGDPGCPGAEGPAGIPGFLGLKGPKGREGHAGFPGVPGPPGHSCERGAPGIPGQPGLPGYPGSPGAPGGKGQPGDVGPPGPAGMKGLPGLPGRPGAHGPPGLPGIPGPFGDDGLPGPPGPKGPRGLPGFPGFPGERGKPGAEGCPGAKGEPGEKGMSGLPGDRGLRGAKGAIGPPGDEGEMAIISQKGTPGEPGPPGDDGFPGERGDKGTPGMQGRRGEPGRYGPPGFHRGEPGEKGQPGPPGPPGPPGSTGLRGFIGFPGLPGDQGEPGSPGPPGFSGIDGARGPKGNKGDPASHFGPPGPKGEPGSPGCPGHFGASGEQGLPGIQGPRGSPGRPGPPGSSGPPGCPGDHGMPGLRGQPGEMGDPGPRGLQGDPGIPGPPGIKGPSGSPGLNGLHGLKGQKGTKGASGLHDVGPPGPVGIPGLKGERGDPGSPGISPPGPRGKKGPPGPPGSSGPPGPAGATGRAPKDIPDPGPPGDQGPPGPDGPRGAPGPPGLPGSVDLLRGEPGDCGLPGPPGPPGPPGPPGYKGFPGCDGKDGQKGPVGFPGPQGPHGFPGPPGEKGLPGPPGRKGPTGLPGPRGEPGPPADVDDCPRIPGLPGAPGMRGPEGAMGLPGMRGPSGPGCKGEPGLDGRRGVDGVPGSPGPPGRKGDTGEDGYPGGPGPPGPIGDPGPKGFGPGYLGGFLLVLHSQTDQEPTCPLGMPRLWTGYSLLYLEGQEKAHNQDLGLAGSCLPVFSTLPFAYCNIHQVCHYAQRNDRSYWLASAAPLPMMPLSEEAIRPYVSRCAVCEAPAQAVAVHSQDQSIPPCPQTWRSLWIGYSFLMHTGAGDQGGGQALMSPGSCLEDFRAAPFLECQGRQGTCHFFANKYSFWLTTVKADLQFSSAPAPDTLKESQAQRQKISRCQVCVKYS

SEQ ID NO: 496 - protein, 1685 aa, Homo sapiens
MKLRGVSLAAGLFLLALSLWGQPAEAAACYGCSPGSKCDCSGIKGEKGERGFPGLEGHPGLPGFPGPEGPPGPRGQKGDDGIPGPPGPKGIRGPPGLPGFPGTPGLPGMPGHDGAPGPQGIPGCNGTKGERGFPGSPGFPGLQGPPGPPGIPGMKGEPGSIIMSSLPGPKGNPGYPGPPGIQGLPGPTGIPGPIGPPGPPGLMGPPGPPGLPGPKGNMGLNFQGPKGEKGEQGLQGPPGPPGQISEQKRPIDVEFQKGDQGLPGDRGPPGPPGIRGPPGPPGGEKGEKGEQGEPGKRGKPGKDGENGQPGIPGLPGDPGYPGEPGRDGEKGQKGDTGPPGPPGLVIPRPGTGITIGEKGNIGLPGLPGEKGERGFPGIQGPPGLPGPPGAAVMGPPGPPGFPGERGQKGDEGPPGISIPGPPGLDGQPGAPGLPGPPGPAGPHIPPSDEICEPGPPGPPGSPGDKGLQGEQGVKGDKGDTCFNCIGTGISGPPGQPGLPGLPGPPGSLGFPGQKGEKGQAGATGPKGLPGIPGAPGAPGFPGSKGEPGDILTFPGMKGDKGELGSPGAPGLPGLPGTPGQDGLPGLPGPKGEPGGITFKGERGPPGNPGLPGLPGNIGPMGPPGFGPPGPVGEKGIQGVAGNPGQPGIPGPKGDPGQTITQPGKPGLPGNPGRDGDVGLPGDPGLPGQPGLPGIPGSKGEPGIPGIGLPGPPGPKGFPGIPGPPGAPGTPGRIGLEGPPGPPGFPGPKGEPGFALPGPPGPPGLPGFKGALGPKGDRGFPGPPGPPGRTGLDGLPGPKGDVGPNGQPGPMGPPGLPGIGVQGPPGPPGIPGPIGQPGLHGIPGEKGDPGPPGLDVPGPPGERGSPGIPGAPGPIGPPGSPGLPGKAGASGFPGTKGEMGMMGPPGPPGPLGIPGRSGVPGLKGDDGLQGQPGLPGPTGEKGSKGEPGLPGPPGPMDPNLLGSKGEKGEPGLPGIPGVSGPKGYQGLPGDPGQPGLSGQPGLPGPPGPKGNPGLPGQPGLIGPPGLKGTIGDMGFPGPQGVEGPPGPSGVPGQPGSPGLPGQKGDKGDPGISSIGLPGLPGPKGEPGLPGYPGNPGIKGSVGDPGLPGLPGTPGAKGQPGLPGFPGTPGPPGPKGISGPPGNPGLPGEPGPVGGGGHPGQPGPPGEKGKPGQDGIPGPAGQKGEPGQPGFGNPGPPGLPGLSGQKGDGGLPGIPGNPGLPGPKGEPGFHGFPGVQGPPGPPGSPGPALEGPKGNPGPQGPPGRPGLPGPEGPPGLPGNGGIKGEKGNPGQPGLPGLPGLKGDQGPPGLQGNPGRPGLNGMKGDPGLPGVPGFPGMKGPSGVPGSAGPEGEPGLIGPPGPPGLPGPSGQSIIIKGDAGPPGIPGQPGLKGLPGPQGPQGLPGPTGPPGDPGRNGLPGFDGAGGRKGDPGLPGQPGTRGLDGPPGPDGLQGPPGPPGTSSVAHGFLITRHSQTTDAPQCPQGTLQVYEGFSLLYVQGNKRAHGQDLGTAGSCLRRFSTMPFMFCNINNVCNFASRNDYSYWLSTPEPMPMSMQPLKGQSIQPFISRCAVCEAPAVVIAVHSQTIQIPHCPQGWDSLWIGYSFMMHTSAGAEGSGQALASPGSCLEEFRSAPFIECHGRGTCNYYANSYSFWLATVDVSDMFSKPQSETLKAGDLRTRISRCQVCMKRT

SEQ ID NO: 497 - protein, 1691 aa, Homo sapiens
MLINKLWLLLVTLCLTEELAAAGEKSYGKPCGGQDCSGSCQCFPEKGARGRPGPIGIQGPTGPQGFTGSTGLSGLKGERGFPGLLGPYGPKGDKGPMGVPGFLGINGIPGHPGQPGPRGPPGLDGCNGTQGAVGFPGPDGYPGLLGPPGLPGQKGSKGDPVLAPGSFKGMKGDPGLPGLDGITGPQGAPGFPGAVGPAGPPGLQGPPGPPGPLGPDGNMGLGFQGEKGVKGDVGLPGPAGPPPSTGELEFMGFPKGKKGSKGEPGPKGFPGISGPPGFPGLGTTGEKGEKGEKGIPGLPGPRGPMGSEGVQGPPGQQGKKGTLGFPGLNGFQGIEGQKGDIGLPGPDVFIDIDGAVISGNPGDPGVPGLPGLKGDEGIQGLRGPSGVPGLPALSGVPGALGPQGFPGLKGDQGNPGRTTIGAAGLPGRDGLPGPPGPPGPPSPEFETETLHNKESGFPGLRGEQGPKGNLGLKGIKGDSGFCACDGGVPNTGPPGEPGPPGPWGLIGLPGLKGARGDRGSGGAQGPAGAPGLVGPLGPSGPKGKKGEPILSTIQGMPGDRGDSGSQGFRGVIGEPGKDGVPGLPGLPGLPGDGGQGFPGEKGLPGLPGEKGHPGPPGLPGNGLPGLPGPRGLPGDKGKDGLPGQQGLPGSKGITLPCIIPGSYGPSGFPGTPGFPGPKGSRGLPGTPGQPGSSGSKGEPGSPGLVHLPELPGFPGPRGEKGLPGFPGLPGKDGLPGMIGSPGLPGSKGATGDIFGAENGAPGEQGLQGLTGHKGFLGDSGLPGLKGVHGKPGLLGPKGERGSPGTPGQVGQPGTPGSSGPYGIKGKSGLPGAPGFPGISGHPGKKGTRGKKGPPGSIVKKGLPGLKGLPGNPGLVGLKGSPGSPGVAGLPALSGPKGEKGSVGFVGFPGIPGLPGIPGTRGLKGIPGSTGKMGPSGRAGTPGEKGDRGNPGPVGIPSPRRPMSNLWLKGDKGSQGSAGSNGFPGPRGDKGEAGRPGPPGLPGAPGLPGIIKGVSGKPGPPGFMGIRGLPGLKGSSGITGFPGMPGESGSQGIRGSPGLPGASGLPGLKGDNGQTVEISGSPGPKGQPGESGFKGTKGRDGLIGNIGFPGNKGEDGKVGVSGDVGLPGAPGFPGVAGMRGEPGLPGSSGHQGAIGPLGSPGLIGPKGFPGFPGLHGLNGLPGTKGTHGTPGPSITGVPGPAGLPGPKGEKGYPGIGIGAPGKPGLRGQKGDRGFPGLQGPAGLPGAPGISLPSLIAGQPGDPGRPGLDGERGRPGPAGPPGPPGPSSNQGDTGDPGFPGIPGPKGPKGDQGIPGFSGLPGELGLKGMRGEPGFMGTPGKVGPPGDPGFPGMKGKAGPRGSSGLQGDPGQTPTAEAVQVPPGPLGLPGIDGIPGLTGDPGAQGPVGLQGSKGLPGIPGKDGPSGLPGPPGALGDPGLPGLQGPPGFEGAPGQQGPFGMPGMPGQSMRVGYTLVKHSQSEQVPPCPIGMSQLWVGYSLLFVEGQEKAHNQDLGFAGSCLPRFSTMPFIYCNINEVCHYARRNDKSYWLSTTAPIPMMPVSQTQIPQYISRCSVCEAPSQAIAVHSQDITIPQCPLGWRSLWIGYSFLMHTAAGAEGGGQSLVSPGSCLEDFRATPFIECSGARGTCHYFANKYSFWLTTVEERQQFGELPVSETLKAGQLHTRVSRCQVCMKSL

SEQ ID NO: 498 - protein, 2944 aa, Homo sapiens; identical to SEQ ID NO: 490

SEQ ID NO: 499 - protein, 1838 aa, Homo sapiens
MDVHTRWKARSALRPGAPLLPPLLLLLLWAPPPSRAAQPADLLKVLDFHNLPDGITKTTGFCATRRSSKGPDVAYRVTKDAQLSAPTKQLYPASAFPEDFSILTTVKAKKGSQAFLVSIYNEQGIQQIGLELGRSPVFLYEDHTGKPGPEDYPLFRGINLSDGKWHRIALSVHKKNVTLILDCKKKTTKFLDRSDHPMIDINGIIVFGTRILDEEVFEGDIQQLLFVSDHRAAYDYCEHYSPDCDTAVPDTPQSQDPNPDEYYTEGDGEGETYYYEYPYYEDPEDLGKEPTPSKKPVEAAKETTEVPEELTPTPTEAAPMPETSEGAGKEEDVGIGDYDYVPSEDYYTPSPYDDLTYGEGEENPDQPTDPGAGAEIPTSTADTSNSSNPAPPPGEGADDLEGEFTEETIRNLDENYYDPYYDPTSSPSEIGPGMPANQDTIYEGIGGPRGEKGQKGEPAIIEPGMLIEGPPGPEGPAGLPGPPGTMGPTGQVGDPGERGPPGRPGLPGADGLPGPPGTMLMLPFRFGGGGDAGSKGPMVSAQESQAQAILQQARLALRGPAGPMGLTGRPGPVGPPGSGGLKGEPGDVGPQGPRGVQGPPGPAGKPGRRGRAGSDGARGMPGQTGPKGDRGFDGLAGLPGEKGHRGDPGPSGPPGPPGDDGERGDDGEVGPRGLPGEPGPRGLLGPKGPPGPPGPPGVTGMDGQPGPKGNVGPQGEPGPPGQQGNPGAQGLPGPQGAIGPPGEKGPLGKPGLPGMPGADGPPGHPGKEGPPGEKGGQGPPGPQGPIGYPGPRGVKGADGIRGLKGTKGEKGEDGFPGFKGDMGIKGDRGEIGPPGPRGEDGPEGPKGRGGPNGDPGPLGPPGEKGKLGVPGLPGYPGRQGPKGSIGFPGFPGANGEKGGRGTPGKPGPRGQRGPTGPRGERGPRGITGKPGPKGNSGGDGPAGPPGERGPNGPQGPTGFPGPKGPPGPPGKDGLPGHPGQRGETGFQGKTGPPGPPGVVGPQGPTGETGPMGERGHPGPPGPPGEQGLPGLAGKEGTKGDPGPAGLPGKDGPPGLRGFPGDRGLPGPVGALGLKGNEGPPGPPGPAGSPGERGPAGAAGPIGIPGRPGPQGPPGPAGEKGAPGEKGPQGPAGRDGLQGPVGLPGPAGPVGPPGEDGDKGEIGEPGQKGSKGDKGEQGPPGPTGPQGPIGQPGPSGADGEPGPRGQQGLFGQKGDEGPRGFPGPPGPVGLQGLPGPPGEKGETGDVGQMGPPGPPGPRGPSGAPGADGPQGPPGGIGNPGAVGEKGEPGEAGEPGLPGEGGPPGPKGERGEKGESGPSGAAGPPGPKGPPGDDGPKGSPGPVGFPGDPGPPGEPGPAGQDGPPGDKGDDGEPGQTGSPGPTGEPGPSGPPGKRGPPGPAGPEGRQGEKGAKGEAGLEGPPGKTGPIGPQGAPGKPGPDGLRGIPGPVGEQGLPGSPGPDGPPGPMGPPGLPGLKGDSGPKGEKGHPGLIGLIGPPGEQGEKGDRGLPGPQGSSGPKGEQGITGPSGPIGPPGPPGLPGPPGPKGAKGSSGPTGPKGEAGHPGPPGPPGPPGEVIQPLPIQASRTRRNIDASQLLDDGNGENYVDYADGMEEIFGSLNSLKLEIEQMKRPLGTQQNPARTCKDLQLCHPDFPDGEYWVDPNQGCSRDSFKVYCNFTAGGSTCVFPDKKSEGARITSWPKENPGSWFSEFKRGKLLSYVDAEGNPVGVVQMTFLRLLSASAHQNVTYHCYQSVAWQDAATGSYDKALRFLGSNDEEMSYDNNPYIRALVDGCATKKGYQKTVLEIDTPKVEQVPIVDIMFNDFGEASQKFGFEVGPACFMG

SEQ ID NO: 500 - protein, 1499 aa, Homo sapiens
MMANWAEARPLLILIVLLGQFVSIKAQEEDEDEGYGEEIACTQNGQMYLNRDIWKPAPCQICVCDNGAILCDKIECQDVLDCADPVTPPGECCPVCSQTPGGGNTNFGRGRKGQKGEPGLVPVVTGIRGRPGPAGPPGSQGPRGERGPKGRPGPRGPQGIDGEPGVPGQPGAPGPPGHPSHPGPDGLSRPFSAQMAGLDEKSGLGSQVGLMPGSVGPVGPRGPQGLQGQQGGAGPTGPPGEPGDPGPMGPIGSRGPEGPPGKPGEDGEPGRNGNPGEVGFAGSPGARGFPGAPGLPGLKGHRGHKGLEGPKGEVGAPGSKGEAGPTGPMGAMGPLGPRGMPGERGRLGPQGAPGQRGAHGMPGKPGPMGPLGIPGSSGFPGNPGMKGEAGPTGARGPEGPQGQRGETGPPGPVGSPGLPGAIGTDGTPGAKGPTGSPGTSGPPGSAGPPGSPGPQGSTGPQGIRGQPGDPGVPGFKGEAGPKGEPGPHGIQGPIGPPGEEGKRGPRGDPGTVGPPGPVGERGAPGNRGFPGSDGLPGPKGAQGERGPVGSSGPKGSQGDPGRPGEPGLPGARGLTGNPGVQGPEGKLGPLGAPGEDGRPGPPGSIGIRGQPGSMGLPGPKGSSGDPGKPGEAGNAGVPGQRGAPGKDGEVGPSGPVGPPGLAGERGEQGPPGPTGFQGLPGPPGPPGEGGKPGDQGVPGDPGAVGPLGPRGERGNPGERGEPGITGLPGEKGMAGGHGPDGPKGSPGPSGTPGDTGPPGLQGMPGERGIAGTPGPKGDRGGIGEKGAEGTAGNDGARGLPGPLGPPGPAGPTGEKGEPGPRGLVGPPGSRGNPGSRGENGPTGAVGFAGPQGPDGQPGVKGEPGEPGQKGDAGSPGPQGLAGSPGPHGPNGVPGLKGGRGTQGPPGATGFPGSAGRVGPPGPAGAPGPAGPLGEPGKEGPPGLRGDPGSHGRVGDRGPAGPPGGPGDKGDPGEDGQPGPDGPPGPAGTTGQRGIVGMPGQRGERGMPGLPGPAGTPGKVGPTGATGDKGPPGPVGPPGSNGPVGEPGPEGPAGNDGTPGRDGAVGERGDRGDPGPAGLPGSQGAPGTPGPVGAPGDAGQRGDPGSRGPIGPPGRAGKRGLPGPQGPRGDKGDHGDRGDRGQKGHRGFTGLQGLPGPPGPNGEQGSAGIPGPFGPRGPPGPVGPSGKEGNPGPLGPIGPPGVRGSVGEAGPEGPPGEPGPPGPPGPPGHLTAALGDIMGHYDESMPDPLPEFTEDQAAPDDKNKTDPGVHATLKSLSSQIETMRSPDGSKKHPARTCDDLKLCHSAKQSGEYWIDPNQGSVEDAIKVYCNMETGETCISANPSSVPRKTWWASKSPDNKPVWYGLDMNRGSQFAYGDHQSPNTAITQMTFLRLLSKEASQNITYICKNSVGYMDDQAKNLKKAVVLKGANDLDIKAEGNIRFRYIVLQDTCSKRNGNVGKTVFEYRTQNVARLPIIDLAPVDVGGTDQEFGVEIGPVCFV

SEQ ID NO: 501 - protein, 1745 aa, Homo sapiens
MGNRRDLGQPRAGLCLLLAALQLLPGTQADPVDVLKALGVQGGQAGVPEGPGFCPQRTPEGDRAFRIGQASTLGIPTWELFPEGHFPENFSLLITLRGQPANQSVLLSIYDERGARQLGLALGPALGLLGDPFRPLPQQVNLTDGRWHRVAVSIDGEMVTLVADCEAQPPVLGHGPRFISIAGLTVLGTQDLGEKTFEGDIQELLISPDPQAAFQACERYLPDCDNLAPAATVAPQGEPETPRPRRKGKGKGRKKGRGRKGKGRKKNKEIWTSSPPPDSAENQTSTDIPKTETPAPNLPPTPTPLVVTSTVTTGLNATILERSLDPDSGTELGTLETKAAREDEEGDDSTMGPDFRAAEYPSRTQFQIFPGAGEKGAKGEPAVIEKGQQFEGPPGAPGPQGVVGPSGPPGPPGFPGDPGPPGPAGLPGIPGIDGIRGPPGTVIMMPFQFAGGSFKGPPVSFQQAQAQAVLQQTQLSMKGPPGPVGLTGRPGPVGLPGHPGLKGEEGAEGPQGPRGLQGPHGPPGRVGKMGRPGADGARGLPGDTGPKGDRGFDGLPGLPGEKGQRGDFGHVGQPGPPGEDGERGAEGPPGPTGQAGEPGPRGLLGPRGSPGPTGRPGVTGIDGAPGAKGNVGPPGEPGPPGQQGNHGSQGLPGPQGLIGTPGEKGPPGNPGIPGLPGSDGPLGHPGHEGPTGEKGAQGPPGSAGPPGYPGPRGVKGTSGNRGLQGEKGEKGEDGFPGFKGDVGLKGDQGKPGAPGPRGEDGPEGPKGQAGQAGEEGPPGSAGEKGKLGVPGLPGYPGRPGPKGSIGFPGPLGPIGEKGKSGKTGQPGLEGERGPPGSRGERGQPGATGQPGPKGDVGQDGAPGIPGEKGLPGLQGPPGFPGPKGPPGHQGKDGRPGHPGQRGELGFQGQTGPPGPAGVLGPQGKTGEVGPLGERGPPGPPGPPGEQGLPGLEGREGAKGELGPPGPLGKEGPAGLRGFPGPKGGPGDPGPTGLKGDKGPPGPVGANGSPGERGPLGPAGGIGLPGQSGSEGPVGPAGKKGSRGERGPPGPTGKDGIPGPLGPLGPPGAAGPSGEEGDKGDVGAPGHKGSKGDKGDAGPPGQPGIRGPAGHPGPPGADGAQGRRGPPGLFGQKGDDGVRGFVGVIGPPGLQGLPGPPGEKGEVGDVGSMGPHGAPGPRGPQGPTGSEGTPGLPGGVGQPGAVGEKGERGDAGDPGPPGAPGIPGPKGDIGEKGDSGPSGAAGPPGKKGPPGEDGAKGSVGPTGLPGDLGPPGDPGVSGIDGSPGEKGDPGDVGGPGPPGASGEPGAPGPPGKRGPSGHMGREGREGEKGAKGEPGPDGPPGRTGPMGARGPPGRVGPEGLRGIPGPVGEPGLLGAPGQMGPPGPLGPSGLPGLKGDTGPKGEKGHIGLIGLIGPPGEAGEKGDQGLPGVQGPPGPKGDPGPPGPIGSLGHPGPPGVAGPLGQKGSKGSPGSMGPRGDTGPAGPPGPPGAPAELHGLRRRRRFVPVPLPVVEGGLEEVLASLTSLSLELEQLRRPPGTAERPGLVCHELHRNHPHLPDGEYWIDPNQGCARDSFRVFCNFTAGGETCLYPDKKFEIVKLASWSKEKPGGWYSTFRRGKKFSYVDADGSPVNVVQLNFLKLLSATARQNFTYSCQNAAAWLDEATGDYSHSARFLGTNGEELSFNQTTAATVSVPQDGCRLRKGQTKTLFEFSSSRAGFLPLWDVAATDFGQTNQKFGFELGPVCFSS

SEQ ID NO: 502 - protein, 824 aa, Homo sapiens
MRQSLLFLTSVVPFVLAPRPPDDPGFGPHQRLEKLDSLLSDYDILSLSNIQQHSVRKRDLQTSTHVETLLTFSALKRHFKLYLTSSTERFSQNFKVVVVDGKNESEYTVKWQDFFTGHVVGEPDSRVLAHIRDDDVIIRINTDGAEYNIEPLWRFVNDTKDKRMLVYKSEDIKNVSRLQSPKVCGYLKVDNEELLPKGLVDREPPEELVHRVKRRADPDPMKNTCKLLVVADHRFYRYMGRGEESTTTNYLIELIDRVDDIYRNTSWDNAGFKGYGIQIEQIRILKSPQEVKPGEKHYNMAKSYPNEEKDAWDVKMLLEQFSFDIAEEASKVCLAHLFTYQDFDMGTLGLAYVGSPRANSHGGVCPKAYYSPVGKKNIYLNSGLTSTKNYGKTILTKEADLVTTHELGHNFGAEHDPDGLAECAPNEDQGGKYVMYPIAVSGDHENNKMFSNCSKQSIYKTIESKAQECFQERSNKVCGNSRVDEGEECDPGIMYLNNDTCCNSDCTLKEGVQCSDRNSPCCKNCQFETAQKKCQEAINATCKGVSYCTGNSSECPPPGNAEDDTVCLDLGKCKDGKCIPFCEREQQLESCACNETDNSCKVCCRDLSGRCVPYVDAEQKNLFLRKGKPCTVGFCDMNGKCEKRVQDVIERFWDFIDQLSINTFGKFLADNIVGSVLVFSLIFWIPFSILVHCVDKKLDKQYESLSLFHPSNVEMLSSMDSASVRIIKPFPAPQTPGRLQPAPVIPSAPAAPKLDHQRMDTIQEDPSTDSHMDEDGFEKDPFPNSSTAAKSFEDLTDHPVTRSEKAASFKLQRQNRVDSKETEC

SEQ ID NO: 503 - protein, 423 aa, Homo sapiens
MRSLGANMAAALRAAGVLLRDPLASSSWRVCQPWRWKSGAAAAAVTTETAQHAQGAKPQVQPQKRKPKTGILMLNMGGPETLGDVHDFLLRLFLDRDLMTLPIQNKLAPFIAKRRTPKIQEQYRRIGGGSPIKIWTSKQGEGMVKLLDELSPNTAPHKYYIGFRYVHPLTEEAIEEMERDGLERAIAFTQYPQYSCSTTGSSLNAIYRYYNQVGRKPTMKWSTIDRWPTHHLLIQCFADHILKELDHFPLEKRSEVVILFSAHSLPMSVVNRGDPYPQEVSATVQKVMERLEYCNPYRLVWQSKVGPMPWLGPQTDESIKGLCERGRKNILLVPIAFTSDHIETLYELDIEYSQVLAKECGVENIRRAESLNGNPLFSKALADLVHSHIQSNELCSKQLTLSCPLCVNPVCRETKSFFTSQQL

SEQ ID NO: 504 - protein, 307 aa, Homo sapiens
MGGLTASDVHPTLGVQLFSAGIAACLADVITFPLDTAKVRLQVQGECPTSSVIRYKGVLGTITAVVKTEGRMKLYSGLPAGLQRQISSASLRIGLYDTVQEFLTAGKETAPSLGSKILAGLTTGGVAVFIGQPTEVVKVRLQAQSHLHGIKPRYTGTYNAYRIIATTEGLTGLWKGTTPNLMRSVIINCTELVTYDLMKEAFVKNNILADDVPCHLVSALIAGFCATAMSSPVDVVKTRFINSPPGQYKSVPNCAMKVFTNEGPTAFFKGLVPSFLRLGSWNVIMFVCFEQLKRELSKSRQTMDCAT

SEQ ID NO: 505 - protein, 1118 aa, Homo sapiens
MARSPGRAYALLLLLICFNVGSGLHLQVLSTRNENKLLPKHPHLVRQKRAWITAPVALREGEDLSKKNPIAKIHSDLAEERGLKITYKYTGKGITEPPFGIFVFNKDTGELNVTSILDREETPFFLLTGYALDARGNNVEKPLELRIKVLDINDNEPVFTQDVFVGSVEELSAAHTLVMKINATDADEPNTLNSKISYRIVSLEPAYPPVFYLNKDTGEIYTTSVTLDREEHSSYTLTVEARDGNGEVTDKPVKQAQVQIRILDVNDNIPVVENKVLEGMVEENQVNVEVTRIKVFDADEIGSDNWLANFTFASGNEGGYFHIETDAQTNEGIVTLIKEVDYEEMKNLDFSVIVANKAAFHKSIRSKYKPTPIPIKVKVKNVKEGIHFKSSVISIYVSESMDRSSKGQIIGNFQAFDEDTGLPAHARYVKLEDRDNWISVDSVTSEIKLAKLPDFESRYVQNGTYTVKIVAISEDYPRKTITGTVLINVEDINDNCPTLIEPVQTICHDAEYVNVTAEDLDGHPNSGPFSFSVIDKPPGMAEKWKIARQESTSVLLQQSEKKLGRSEIQFLISDNQGFSCPEKQVLTLTVCECLHGSGCREAQHDSYVGLGPAAIALMILAFLLLLLVPLLLLMCHCGKGAKGFTPIPGTIEMLHPWNNEGAPPEDKVVPSFLPVDQGGSLVGRNGVGGMAKEATMKGSSSASIVKGQHEMSEMDGRWEEHRSLLSGRATQFTGATGAIMTTETTKTARATGASRDMAGAQAAAVALNEEFLRNYFTDKAASYTEEDENHTAKDCLLVYSQEETESLNASIGCCSFIEGELDDRFLDDLGLKFKTLAEVCLGQKIDINKEIEQRQKPATETSMNTASHSLCEQTMVNSENTYSSGSSFPVPKSLQEANAEKVTQEIVTERSVSSRQAQKVATPLPDPMASRNVIATETSYVTGSTMPPTTVILGPSQPQSLIVTERVYAPASTLVDQPYANEGTVVVTERVIQPHGGGSNPLEGTQHLQDVPYVMVRERESFLAPSSGVQPTLAMPNIAVGQNVTVTERVLAPASTLQSSYQIPTENSMTARNTTVSGAGVPGPLPDFGLEESGHSNSTITTSSTRVTKHSTVQHSYS

SEQ ID NO: 506 - protein, 747 aa, Homo sapiens
MNHSPLKTALAYECFQDQDNSTLALPSDQKMKTGTSGRQRVQEQVMMTVKRQKSKSSQSSTLSHSNRGSMYDGLADNYNYGTTSRSSYYSKFQAGNGSWGYPIYNGTLKREPDNRRFSSYSQMENWSRHYPRGSCNTTGAGSDICFMQKIKASRSEPDLYCDPRGTLRKGTLGSKGQKTTQNRYSFYSTCSGQKAIKKCPVRPPSCASKQDPVYIPPISCNKDLSFGHSRASSKICSEDIECSGLTIPKAVQYLSSQDEKYQAIGAYYIQHTCFQDESAKQQVYQLGGICKLVDLLRSPNQNVQQAAAGALRNLVFRSTTNKLETRRQNGIREAVSLLRRTGNAEIQKQLTGLLWNLSSTDELKEELIADALPVLADRVIIPFSGWCDGNSNMSREVVDPEVFFNATGCLRKRLGMRELLALVPQRATSSRVNLSSADAGRQTMRNYSGLIDSLMAYVQNCVAASRCDDKSVENCMCVLHNLSYRLDAEVPTRYRQLEYNARNAYTEKSSTGCFSNKSDKMMNNNYDCPLPEEETNPKGSGWLYHSDAIRTYLNLMGKSKKDATLEACAGALQNLTASKGLMSSGMSQLIGLKEKGLPQIARLLQSGNSDVVRSGASLLSNMSRHPLLHRVMGNQVFPEVTRLLTSHTGNTSNSEDILSSACYTVRNLMASQPQLAKQYFSSSMLNNIINLCRSSASPKAAEAARLLLSDMWSSKELQGVLRQQGFDRNMLGTLAGANSLRNFTSRF

SEQ ID NO: 507 - protein, 713 aa, Homo sapiens
MATGQDRVVALVDMDCFFVQVEQRQNPHLRNKPCAVVQYKSWKGGGIIAVSYEARAFGVTRSMWADDAKKLCPDLLLAQVRESRGKANLTKYREASVEVMEIMSRFAVIERASIDEAYVDLTSAVQERLQKLQGQPISADLLPSTYIEGLPQGPTTAEETVQKEGMRKQGLFQWLDSLQIDNLTSPDLQLTVGAVIVEEMRAAIERETGFQCSAGISHNKVLAKLACGLNKPNRQTLVSHGSVPQLFSQMPIRKIRSLGGKLGASVIEILGIEYMGELTQFTESQLQSHFGEKNGSWLYAMCRGIEHDPVKPRQLPKTIGCSKNFPGKTALATREQVQWWLLQLAQELEERLTKDRNDNDRVATQLVVSIRVQGDKRLSSLRRCCALTRYDAHKMSHDAFTVIKNCNTSGIQTEWSPPLTMLFLCATKFSASAPSSSTDITSFLSSDPSSLPKVPVTSSEAKTQGSGPAVTATKKATTSLESFFQKAAERQKVKEASLSSLTAPTQAPMSNSPSKPSLPFQTSQSTGTEPFFKQKSLLLKQKQLNNSSVSSPQQNPWSNCKALPNSLPTEYPGCVPVCEGVSKLEESSKATPAEMDLAHNSQSMHASSASKSVLEVTQKATPNPSLLAAEDQVPCEKCGSLVPVWDMPEHMDYHFALELQKSFLQPHSSNPQVVSAVSHQGKRNPKSPLACTNKRPRPEGMQTLESFFKPLTH

SEQ ID NO: 508 - protein, 115 aa, Homo sapiens
MIPAKDMAKVMIVMLAICFLTKSDGKSVKKRSVSEIQLMHNLGKHLNSMERVEWLRKKLQDVHNFVALGAPLAPRDAGSQRPRKKEDNVLVESHEKSLGEADKADVNVLTKAKSQ

SEQ ID NO: 509 - protein, 730 aa, Homo sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEAACGGFLTKLNGSITSPGWPKEYPPNKNCIWQLVAPTQYRISLQFDFFETEGNDVCKYDFVEVRSGLTADSKLHGKFCGSEKPEVITSQYNNMRVEFKSDNTVSKKGFKAHFFSEKRPALQPPRGRPHQLKFRVQKRNRTPQ

SEQ ID NO: 510 - protein, 302 aa, Homo sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGVLHSSLLLLSCGSRNGASFPCSLESSTHQALCWTGLFLRPSPFPRLPLAAPRTLRAGV

SEQ ID NO: 511 - protein, 622 aa, Homo sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEGCYDLQVGKPLLWDRHCFRLSTHGPEMLGTALRG

SEQ ID NO: 512 - protein, 717 aa, Homo sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEAACGGFLTKLNGSITSPGWPKEYPPNKNCIWQLVAPTQYRISLQFDFFETEGNDVCKYDFVEVRSGLTADSKLHGKFCGSEKPEVITSQYNNMRVEFKSDNTVSKKGFKAHFFSGGELFGLLGHPPRRP

SEQ ID NO: 513 - protein, 823 aa, Homo sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEAACGGFLTKLNGSITSPGWPKEYPPNKNCIWQLVAPTQYRISLQFDFFETEGNDVCKYDFVEVRSGLTADSKLHGKFCGSEKPEVITSQYNNMRVEFKSDNTVSKKGFKAHFFSVLEGAGDRHSHLSGLELLLCPHALVDTVPAPPSALHGDTHAHTHTHVHTHCPIAQETCRGPPLGASRLSPQGPGHLTLAPQEGSYLDFWDTHRGDPKPRRRRKSLKTFSLTPATFRGIWAL

SEQ ID NO: 514 - protein, 472 aa, Homo sapiens
MAGASRLLFLWLGCFCVSLAQGERPKPPFPELRKAVPGDRTAGGGPDSELQPQDKVSEHMLRLYDRYSTVQAARTPGSLEGGSQPWRPRLLREGNTVRSFRAAAAETLERKGLYIFNLTSLTKSENILSATLYFCIGELGNISLSCPVSGGCSHHAQRKHIQIDLSAWTLKFSRNQSQLLGHLSVDMAKSHRDIMSWLSKDITQLLRKAKENEEFLIGFNITSKGRQLPKRRLPFPEPYILVYANDAAISEPESVVSSLQGHRNFPTGTVPKWDSHIRAALSIERRKKRSTGVLLPLQNNELPGAEYQYKKDEVWEERKPYKTLQAQAPEKSKNKKKQRKGPHRKSQTLQFDEQTLKKARRKQWIEPRNCARRYLKVDFADIGWSEWIISPKSFDAYYCSGACQFPMPKSLKPSNHATIQSIVRAVGVVPGIPEPCCVPEKMSSLSILFFDENKNVVLKVYPNMTVESCACR

SEQ ID NO: 515 - protein, 417 aa, Homo sapiens
MHLTVFLLKGIVGFLWSCWVLVGYAKGGLGDNHVHSSFIYRRLRNHERREIQREILSILGLPHRPRPFSPGKQASSAPLFMLDLYNAMTNEENPEESEYSVRASLAEETRGARKGYPASPNGYPRRIQLSRTTPLTTQSPPLASLHDTNFLNDADMVMSFVNLVERDKDFSHQRRHYKEFRFDLTQIPHGEAVTAAEFRIYKDRSNNRFENETIKISIYQIIKEYTNRDADLFLLDTRKAQALDVGWLVFDITVTSNHWVINPQNNLGLQLCAETGDGRSINVKSAGLVGRQGPQSKQPFMVAFFKASEVLLRSVRAANKRKNQNRNKSSSHQDSSRMSSVGDYNTSEQKQACKKHELYVSFRDLGWQVHLMFPDHVPKPCCAPTKLNAISVLYFDDSSNVILKKYRNMVVRSCGCH

SEQ ID NO: 516 - protein, 475 aa, Homo sapiens
MESKALLVLTLAVWLQSLTASRGGVAAADQRRDFIDIESKFALRTPEDTAEDTCHLIPGVAESVATCHFNHSSKTFMVIHGWTVTGMYESWVPKLVAALYKREPDSNVIVVDWLSRAQEHYPVSAGYTKLVGQDVARFINWMEEEFNYPLDNVHLLGYSLGAHAAGIAGSLTNKKVNRITGLDPAGPNFEYAEAPSRLSPDDADFVDVLHTFTRGSPGRSIGIQKPVGHVDIYPNGGTFQPGCNIGEAIRVIAERGLGDVDQLVKCSHERSIHLFIDSLLNEENPSKAYRCSSKEAFEKGLCLSCRKNRCNNLGYEINKVRAKRSSKMYLKTRSQMPYKVFHYQVKIHFSGTESETHTNQAFEISLYGTVAESENIPFTLPEVSTNKTYSFLIYTEVDIGELLMLKLKWKSDSYFSWSDWWSSPGFAIQKIRVKAGETQKKVIFCSREKVSHLQKGKAPAVFVKCHDKSLNKKSG

SEQ ID NO: 517 - protein, 499 aa, Homo sapiens
MDTSPLCFSILLVLCIFIQSSALGQSLKPEPFGRRAQAVETNKTLHEMKTRFLLFGETNQGCQIRINHPDTLQECGFNSSLPLVMIIHGWSVDGVLENWIWQMVAALKSQPAQPVNVGLVDWITLAHDHYTIAVRNTRLVGKEVAALLRWLEESVQLSRSHVHLIGYSLGAHVSGFAGSSIGGTHKIGRITGLDAAGPLFEGSAPSNRLSPDDANFVDAIHTFTREHMGLSVGIKQPIGHYDFYPNGGSFQPGCHFLELYRHIAQHGFNAITQTIKCSHERSVHLFIDSLLHAGTQSMAYPCGDMNSFSQGLCLSCKKGRCNTLGYHVRQEPRSKSKRLFLVTRAQSPFKVYHYQFKIQFINQTETPIQTTFTMSLLGTKEKMQKIPITLGKGIASNKTYSFLITLDVDIGELIMIKFKWENSAVWANVWDTVQTIIPWSTGPRHSGLVLKTIRVKAGETQQRMTFCSENTDDLLLRPTQEKIFVKCEIKSKTSKRKIR

SEQ ID NO: 518 - protein, 465 aa, Homo sapiens
MLPLWTLSLLLGAVAGKEVCYERLGCFSDDSPWSGITERPLHILPWSPKDVNTRFLLYTNENPNNFQEVAADSSSISGSNFKTNRKTRFIIHGFIDKGEENWLANVCKNLFKVESVNCICVDWKGGSRTGYTQASQNIRIVGAEVAYFVEFLQSAFGYSPSNVHVIGHSLGAHAAGEAGRRTNGTIGRITGLDPAEPCFQGTPELVRLDPSDAKFVDVIHTDGAPIVPNLGFGMSQVVGHLDFFPNGGVEMPGCKKNILSQIVDIDGIWEGTRDFAACNHLRSYKYYTDSIVNPDGFAGFPCASYNVFTANKCFPCPSGGCPQMGHYADRYPGKTNDVGQKFYLDTGDASNFARWRYKVSVTLSGKKVTGHILVSLFGNKGNSKQYEIFKGTLKPDSTHSNEFDSDVDVGDLQMVKFIWYNNVINPTLPRVGASKIIVETNVGKQFNFCSPETVREEVLLTLTPC

SEQ ID NO: 519 - protein, 500 aa, Homo sapiens
MSNSVPLLCFWSLCYCFAAGSPVPFGPEGRLEDKLHKPKATQTEVKPSVRFNLRTSKDPEHEGCYLSVGHSQPLEDCSFNMTAKTFFIIHGWTMSGIFENWLHKLVSALHTREKDANVVVVDWLPLAHQLYTDAVNNTRVVGHSIARMLDWLQEKDDFSLGNVHLIGYSLGAHVAGYAGNFVKGTVGRITGLDPAGPMFEGADIHKRLSPDDADFVDVLHTYTRSFGLSIGIQMPVGHIDIYPNGGDFQPGCGLNDVLGSIAYGTITEVVKCEHERAVHLFVDSLVNQDKPSFAFQCTDSNRFKKGICLSCRKNRCNSIGYNAKKMRNKRNSKMYLKTRAGMPFRVYHYQMKIHVFSYKNMGEIEPTFYVTLYGTNADSQTLPLEIVERIEQNATNTFLVYTEEDLGDLLKIQLTWEGASQSWYNLWKEFRSYLSQPRNPGRELNIRRIRVKSGETQRKLTFCTEDPENTSISPGRELWFRKCRDGWRMKNETSPTVELP

SEQ ID NO: 520 - protein, 399 aa, Homo sapiens
MKMRFLGLVVCLVLWTLHSEGSGGKLTAVDPETNMNVSEIISYWGFPSEEYLVETEDGYILCLNRIPHGRKNHSDKGPKPVVFLQHGLLADSSNWVTNLANSSLGFILADAGFDVWMGNSRGNTWSRKHKTLSVSQDEFWAFSYDEMAKYDLPASINFILNKTGQEQVYYVGHSQGTTIGFIAFSQIPELAKRIKMFFALGPVASVAFCTSPMAKLGRLPDHLIKDLFGDKEFLPQSAFLKWLGTHVCTHVILKELCGNLCFLLCGFNERNLNMSRVDVYTTHSPAGTSVQNMLHWSQAVKFQKFQAFDWGSSAKNYFHYNQSYPPTYNVKDMLVPTAVWSGGHDWLADVYDVNILLTQITNLVFHESIPEWEHLDFIWGLDAPWRLYNKIINLMRKYQ

SEQ ID NO: 521 - protein, 1076 aa, Homo sapiens
MEPGSKSVSRSDWQPEPHQRPITPLEPGPEKTPIAQPESKTLQGSNTQQKPASNQRPLTQQETPAQHDAESQKEPRAQQKSASQEEFLAPQKPAPQQSPYIQRVLLTQQEAASQQGPGLGKESITQQEPALRQRHVAQPGPGPGEPPPAQQEAESTPAAQAKPGAKREPSAPTESTSQETPEQSDKQTTPVQGAKSKQGSLTELGFLTKLQELSIQRSALEWKALSEWVTDSESESDVGSSSDTDSPATMGGMVAQGVKLGFKGKSGYKVMSGYSGTSPHEKTSARNHRHYQDTASRLIHNMDLRTMTQSLVTLAEDNIAFFSSQGPGETAQRLSGVFAGVREQALGLEPALGRLLGVAHLFDLDPETPANGYRSLVHTARCCLAHLLHKSRYVASNRRSIFFRTSHNLAELEAYLAALTQLRALVYYAQRLLVTNRPGVLFFEGDEGLTADFLREYVTLHKGCFYGRCLGFQFTPAIRPFLQTISIGLVSFGEHYKRNETGLSVAASSLFTSGRFAIDPELRGAEFERITQNLDVHFWKAFWNITEMEVLSSLANMASATVRVSRLLSLPPEAFEMPLTADPTLTVTISPPLAHTGPGPVLVRLISYDLREGQDSEELSSLIKSNGQRSLELWPRPQQAPRSRSLIVHFHGGGFVAQTSRSHEPYLKSWAQELGAPIISIDYSLAPEAPFPRALEECFFAYCWAIKHCALLGSTGERICLAGDSAGGNLCFTVALRAAAYGVRVPDGIMAAYPATMLQPAASPSRLLSLMDPLLPLSVLSKCVSAYAGAKTEDHSNSDQKALGMMGLVRRDTALLLRDFRLGASSWLNSFLELSGRKSQKMSEPIAEPMRRSVSEAALAQPQGPLGTDSLKNLTLRDLSLRGNSETSSDTPEMSLSAETLSPSTPSDVNFLLPPEDAGEEAEAKNELSPMDRGLGVRAAFPEGFHPRRSSQGATQMPLYSSPIVKNPFMSPLLAPDSMLKSLPPVHIVACALDPMLDDSVMLARRLRNLGQPVTLRVVEDLPHGFLTLAALCRETRQAAELCVERIRLVLTPPAGAGPSGETGAAGVDGGCGGRH

SEQ ID NO: 522 - protein, 398 aa, Homo sapiens
MWLLLTMASLISVLGTTHGLFGKLHPGSPEVTMNISQMITYWGYPNEEYEVVTEDGYILEVNRIPYGKKNSGNTGQRPVVFLQHGLLASATNWISNLPNNSLAFILADAGYDVWLGNSRGNTWARRNLYYSPDSVEFWAFSFDEMAKYDLPATIDFIVKKTGQKQLHYVGHSQGTTIGFIAFSTNPSLAKRIKTFYALAPVATVKYTKSLINKLRFVPQSLFKFIFGDKIFYPHNFFDQFLATEVCSREMLNLLCSNALFIICGFDSKNFNTSRLDVYLSHNPAGTSVQNMFHWTQAVKSGKFQAYDWGSPVQNRMHYDQSQPPYYNVTAMNVPIAVWNGGKDLLADPQDVGLLLPKLPNLIYHKEIPFYNHLDFIWAMDAPQEVYNDIVSMISEDKK

SEQ ID NO: 523 - protein, 467 aa, Homo sapiens
MLIFWTITLFLLGAAKGKEVCYEDLGCFSDTEPWGGTAIRPLKILPWSPEKIGTRFLLYTNENPNNFQILLLSDPSTIEASNFQMDRKTRFIIHGFIDKGDESWVTDMCKKLFEVEEVNCICVDWKKGSQATYTQAANNVRVVGAQVAQMLDILLTEYSYPPSKVHLIGHSLGAHVAGEAGSKTPGLSRITGLDPVEASFESTPEEVRLDPSDADFVDVIHTDAAPLIPFLGFGTNQQMGHLDFFPNGGESMPGCKKNALSQIVDLDGIWAGTRDFVACNHLRSYKYYLESILNPDGFAAYPCTSYKSFESDKCFPCPDQGCPQMGHYADKFAGRTSEEQQKFFLNTGEASNFARWRYGVSITLSGRTATGQIKVALFGNKGNTHQYSIFRGILKPGSTHSYEFDAKLDVGTIEKVKFLWNNNVINPTLPKVGATKITVQKGEEKTVYNFCSEDTVREDTLLTLTPC

SEQ ID NO: 524 - protein, 469 aa, Homo sapiens
MLPPWTLGLLLLATVRGKEVCYGQLGCFSDEKPWAGTLQRPVKLLPWSPEDIDTRFLLYTNENPNNFQLITGTEPDTIEASNFQLDRKTRFIIHGFLDKAEDSWPSDMCKKMFEVEKVNCICVDWRHGSRAMYTQAVQNIRVVGAETAFLIQALSTQLGYSLEDVHVIGHSLGAHTAAEAGRRLGGRVGRITGLDPAGPCFQDEPEEVRLDPSDAVFVDVIHTDSSPIVPSLGFGMSQKVGHLDFFPNGGKEMPGCKKNVLSTITDIDGIWEGIGGFVSCNHLRSFEYYSSSVLNPDGFLGYPCASYDEFQESKCFPCPAEGCPKMGHYADQFKGKTSAVEQTFFLNTGESGNFTSWRYKVSVTLSGKEKVNGYIRIALYGSNENSKQYEIFKGSLKPDASHTCAIDVDFNVGKIQKVKFLWNKRGINLSEPKLGASQITVQSGEDGTEYNFCSSDTVEENVLQSLYPC

SEQ ID NO: 525 - protein, 753 aa, Homo sapiens
MGRLQLVVLGLTCCWAVASAAKLGAVYTEGGFVEGVNKKLGLLGDSVDIFKGIPFAAPTKALENPQPHPGWQGTLKAKNFKKRCLQATITQDSTYGDEDCLYLNIWVPQGRKQVSRDLPVMIWIYGGAFLMGSGHGANFLNNYLYDGEEIATRGNVIVVTFNYRVGPLGFLSTGDANLPGNYGLRDQHMAIAWVKRNIAAFGGDPNNITLFGESAGGASVSLQTLSPYNKGLIRRAISQSGVALSPWVIQKNPLFWAKKVAEKVGCPVGDAARMAQCLKVTDPRALTLAYKVPLAGLEYPMLHYVGFVPVIDGDFIPADPINLYANAADIDYIAGTNNMDGHIFASIDMPAINKGNKKVTEEDFYKLVSEFTITKGLRGAKTTFDVYTESWAQDPSQENKKKTVVDFETDVLFLVPTEIALAQHRANAKSAKTYAYLFSHPSRMPVYPKWVGADHADDIQYVFGKPFATPTGYRPQDRTVSKAMIAYWTNFAKTGDPNMGDSAVPTHWEPYTTENSGYLEITKKMGSSSMKRSLRTNFLRYWTLTYLALPTVTDQEATPVPPTGDSEATPVPPTGDSETAPVPPTGDSGAPPVPPTGDSGAPPVPPTGDSGAPPVPPTGDSGAPPVPPTGDSGAPPVPPTGDSGAPPVPPTGDSGAPPVPPTGDSGAPPVPPTGDAGPPPVPPTGDSGAPPVPPTGDSGAPPVTPTGDSETAPVPPTGDSGAPPVPPTGDSEAAPVPPTDDSKEAQMPAVIRF

SEQ ID NO: 526 - protein, 13 aa, Homo sapiens
SYSMEHFRWGKPV

SEQ ID NO: 527 - protein, 18 aa, Homo sapiens
DEGPYRMEHFRWGSPPKD

SEQ ID NO: 528 - protein, 11 aa, Homo sapiens
YVMGHFRWDRF

SEQ ID NO: 529 - protein, 267 aa, Homo sapiens
MPRSCCSRSGALLLALLLQASMEVRGWCLESSQCQDLTTESNLLECIRACKPDLSAETPMFPGNGDEQPLTENPRKYVMGHFRWDRFGRRNSSSSGSSGAGQKREDVSAGEDCGPLPEGGPEPRSDGAKPGPREGKRSYSMEHFRWGKPVGKKRRPVKVYPNGAEDESAEAFPLEFKRELTGQRLREGDGPDGPADDGAGAQADLEHSLLVAAEKKDEGPYRMEHFRWGSPPKDKRYGGFMTSEKSQTPLVTLFKNAIIKNAYKKGE

SEQ ID NO: 530 - protein, 189 aa, Homo sapiens
MASPFALLMVLVVLSCKSSCSLGCDLPETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVGETPLMNADSILAVKKYFRRITLYLTEKKYSPCAWEVVRAEIMRSLSLSTNLQERLRRKE

SEQ ID NO: 531 - protein, 188 aa, Homo sapiens [sequence omitted]

SEQ ID NO: 532 - protein, 189 aa, Homo sapiens
MALSFSLLMAVLVLSYKSICSLGCDLPQTHSLGNRRALILLAQMGRISHFSCLKDRHDFGFPEEEFDGHQFQKAQAISVLHEMIQQTFNLFSTEDSSAAWEQSLLEKFSTELYQQLNDLEACVIQEVGVEETPLMNEDSILAVRKYFQRITLYLTEKKYSPCAWEVVRAEIMRSLSFSTNLQKRLRRKD

SEQ ID NO: 533 - protein, 189 aa, Homo sapiens
MALPFVLLMALVVLNCKSICSLGCDLPQTHSLSNRRTLMIMAQMGRISPFSCLKDRHDFGFPQEEFDGNQFQKAQAISVLHEMIQQTFNLFSTKDSSATWDETLLDKFYTELYQQLNDLEACMMQEVGVEDTPLMNVDSILTVRKYFQRITLYLTEKKYSPCAWEVVRAEIMRSFSLSANLQERLRRKE

SEQ ID NO: 534 - protein, 189 aa, Homo sapiens
MALPFALLMALVVLSCKSSCSLDCDLPQTHSLGHRRTMMLLAQMRRISLFSCLKDRHDFRFPQEEFDGNQFQKAEAISVLHEVIQQTFNLFSTKDSSVAWDERLLDKLYTELYQQLNDLEACVMQEVWVGGTPLMNEDSILAVRKYFQRITLYLTEKKYSPCAWEVVRAEIMRSFSSSRNLQERLRRKE

SEQ ID NO: 535 - protein, 189 aa, Homo sapiens
MARSFSLLMVVLVLSYKSICSLGCDLPQTHSLRNRRALILLAQMGRISPFSCLKDRHEFRFPEEEFDGHQFQKTQAISVLHEMIQQTFNLFSTEDSSAAWEQSLLEKFSTELYQQLNDLEACVIQEVGVEETPLMNEDFILAVRKYFQRITLYLMEKKYSPCAWEVVRAEIMRSFSFSTNLKKGLRRKD

SEQ ID NO: 536 - protein, 189 aa, Homo sapiens
MALTFYLLVALVVLSYKSFSSLGCDLPQTHSLGNRRALILLAQMRRISPFSCLKDRHDFEFPQEEFDDKQFQKAQAISVLHEMIQQTFNLFSTKDSSAALDETLLDEFYIELDQQLNDLESCVMQEVGVIESPLMYEDSILAVRKYFQRITLYLTEKKYSSCAWEVVRAEIMRSFSLSINLQKRLKSKE

SEQ ID NO: 537 - protein, 189 aa, Homo sapiens
MALSFSLLMAVLVLSYKSICSLGCDLPQTHSLGNRRALILLGQMGRISPFSCLKDRHDFRIPQEEFDGNQFQKAQAISVLHEMIQQTFNLFSTEDSSAAWEQSLLEKFSTELYQQLNDLEACVIQEVGVEETPLMNEDSILAVRKYFQRITLYLIERKYSPCAWEVVRAEIMRSLSFSTNLQKRLRRKD

SEQ ID NO: 538 - protein, 189 aa, Homo sapiens
MALPFALMMALVVLSCKSSCSLGCNLSQTHSLNNRRTLMLMAQMRRISPFSCLKDRHDFEFPQEEFDGNQFQKAQAISVLHEMMQQTFNLFSTKNSSAAWDETLLEKFYIELFQQMNDLEACVIQEVGVEETPLMNEDSILAVKKYFQRITLYLMEKKYSPCAWEVVRAEIMRSLSFSTNLQKRLRRKD

SEQ ID NO: 539 - protein, 189 aa, Homo sapiens
MALSFSLLMAVLVLSYKSICSLGCDLPQTHSLGNRRALILLAQMGRISHFSCLKDRYDFGFPQEVFDGNQFQKAQAISAFHEMIQQTFNLFSTKDSSAAWDETLLDKFYIELFQQLNDLEACVTQEVGVEEIALMNEDSILAVRKYFQRITLYLMGKKYSPCAWEVVRAEIMRSFSFSTNLQKGLRRKD

SEQ ID NO: 540 - protein, 189 aa, Homo sapiens
MALSFSLLMAVLVLSYKSICSLGCDLPQTHSLGNRRALILLAQMGRISPFSCLKDRHDFGLPQEEFDGNQFQKTQAISVLHEMIQQTFNLFSTEDSSAAWEQSLLEKFSTELYQQLNNLEACVIQEVGMEETPLMNEDSILAVRKYFQRITLYLTEKKYSPCAWEVVRAEIMRSLSFSTNLQKILRRKD

SEQ ID NO: 541 - protein, 189 aa, Homo sapiens
MALSFSLLMAVLVLSYKSICSLGCDLPQTHSLGNRRALILLAQMGRISPFSCLKDRHDFGFPQEEFDGNQFQKAQAISVLHEMIQQTFNLFSTKDSSATWEQSLLEKFSTELNQQLNDLEACVIQEVGVEETPLMNVDSILAVKKYFQRITLYLTEKKYSPCAWEVVRAEIMRSFSLSKIFQERLRRKE

SEQ ID NO: 542 - protein, 166 aa, Homo sapiens
MKYTSYILAFQLCIVLGSLGCYCQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 543 - protein, 187 aa, Homo sapiens
MTNKCLLQIALLLCFSTTALSMSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 544 - protein, 207 aa, Homo sapiens
MSTKPDMIQKCLWLEILMGIFIAGTLSLDCNLLNVHLRRVTWQNLRHLSSMSNSFPVECLRENIAFELPQEFLQYTQPMKRDIKKAFYEMSLQAFNIFSQHTFKYWKERHLKQIQIGLDQQAEYLNQCLEEDKNENEDMKEMKENEMKPSEARVPQLSSLELRRYFHRIDNFLKEKKYSDCAWEIVRVEIRRCLYYFYKFTALFRRK

SEQ ID NO: 545 - protein, 208 aa, Homo sapiens
MIIKHFFGTVLVLLASTTIFSLDLKLIIFQQRQVNQESLKLLNKLQTLSIQQCLPHRKNFLLPQKSLSPQQYQKGHTLAILHEMLQQIFSLFRANISLDGWEENHTEKFLIQLHQQLEYLEALMGLEAEKLSGTLGSDNLRLQVKMYFRRIHDYLENQDYSTCAWAIVQVEISRCLFFVFSLTEKLSKQGRPLNDMKQELTTEFRSPR

SEQ ID NO: 546-547 - skipped (2 entries)

SEQ ID NO: 548 - protein, 153 aa, Homo sapiens
MYRMQLLSCIALSLALVTNSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 549 - protein, 136 aa, Homo sapiens [sequence omitted]

SEQ ID NO: 550 - protein, 135 aa, Homo sapiens
MYRMQLLSCIALSLALVTNSANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 551 - protein, 153 aa, Homo sapiens
MYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 552 - protein, 162 aa, Homo sapiens
MNSFSTSAFGPVAFSLGLLLVLPAAFPAPGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 553 - protein, 166 aa, Homo sapiens
MAALQKSVSSFLMGTLATSCLLLLALLVQGGAAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 554 - protein, 179 aa, Homo sapiens
MAALQKSVSSFLMGTLATSCLLLLALLVQGGAAAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 555 - protein, 155 aa, Homo sapiens; identical to SEQ ID NO: 209

SEQ ID NO: 556 - protein, 135 aa, Homo sapiens
MGNYKPKLLYCSNGGHFLRILPDGTVDGTRDRSDQHIQLQLSAESVGEVYIKSTETGQYLAMDTDGLLYGSQTPNEECLFLERLEENHYNTYISKKHAEKNWFVGLKKNGSCKRGPRTHYGQKAILFLPLPVSSD

SEQ ID NO: 557 - protein, 153 aa, Homo sapiens
MTNKCLLQIALLLCFSTTALSMKPKLLYCSNGGHFLRILPDGTVDGTRDRSDQHIQLQLSAESVGEVYIKSTETGQYLAMDTDGLLYGSQTPNEECLFLERLEENHYNTYISKKHAEKNWFVGLKKNGSCKRGPRTHYGQKAILFLPLPVSSD

SEQ ID NO: 558 - protein, 211 aa, Homo sapiens
MRSGCVVVHVWILAGLWLAVAGRDSSPLVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 559 - protein, 209 aa, Homo sapiens
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 560 - protein, 251 aa, Homo sapiens
MLGARLRLWVCALCSVCSMSVLRAYPNASPLLGSSWGGLIHLYTATARNSYHLQIHKNGHVDGAPHQTIYSALMIRSEDAGFVVITGVMSRRYLCMDFRGNIFGSHYFDPENCRFQHQTLENGYDVYHSPQYHFLVSLGRAKRAFLPGMNPPPYSQFLSRRNEIPLIHFNTPIPRRHTRSAEDDSERDPLNVLKPRARMTPAPASCSQELPSAEDNSPMASDPLGVVRGGRVNTHAGGTGPEGCRPFAKFI

SEQ ID NO: 561 - protein, 247 aa, Homo sapiens
MTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 562 - protein, 379 aa, Homo sapiens
MEQLSSANTRFALDLFLALSENNPAGNIFISPFSISSAMAMVFLGTRGNTAAQLSKTFHFNTVEEVHSRFQSLNADINKRGASYILKLANRLYGEKTYNFLPEFLVSTQKTYGADLASVDFQHASEDARKTINQWVKGQTEGKIPELLASGMVDNMTKLVLVNAIYFKGNWKDKFMKEATTNAPFRLNKKDRKTVKMMYQKKKFAYGYIEDLKCRVLELPYQGEELSMVILLPDDIEDESTGLKKIEEQLTLEKLHEWTKPENLDFIEVNVSLPRFKLEESYTLNSDLARLGVQDLFNSSKADLSGMSGARDIFISKIVHKSFVEVNEEGTEAAAATAGIATFCMLMPEENFTADHPFLFFIRHNSSGSILFLGRFSSP

SEQ ID NO: 563 - protein, 404 aa, Homo sapiens
MADKVLKEKRKLFIRSMGEGTINGLLDELLQTRVLNKEEMEKVKRENATVMDKTRALIDSVIPKGAQACQICITYICEEDSYLAGTLGLSADQTSGNYLNMQDSQGVLSSFPAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKDSVGVSGNLSLPTTEEFEDDAIKKAHIEKDFIAFCSSTPDNVSWRHPTMGSVFIGRLIEHMQEYACSCDVEEIFRKVRFSFEQPDGRAQMPTTERVTLTRCFYLFPGH

SEQ ID NO: 564 - protein, 202 aa, Homo sapiens
MKVLAAGVVPLLLVLHWKHGAGSPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSALSLHSKLNATADILRGLLSNVLCRLCSKYHVGHVDVTYGPDTSGKDVFQKKKLGCQLLGKYKQIIAVLAQAF

SEQ ID NO: 565 - protein, 161 aa, Homo sapiens
MDSDETGFEHSGLWVSVLAGLLLGACQAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 566 - protein, 154 aa, Homo sapiens
MTNKCLLQIALLLCFSTTALSMKKPKLLYCSNGGHFLRILPDGTVDGTRDRSDQHIQLQLSAESVGEVYIKSTETGQYLAMDTDGLLYGSQTPNEECLFLERLEENHYNTYISKKHAEKNWFVGLKKNGSCKRGPRTHYGQKAILFLPLPVSSD

SEQ ID NO: 567 - protein, 753 aa, Homo sapiens
MERRAWSLQCTAFVLFCAWCALNSAKAKRQFVNEWAAEIPGGPEAASAIAEELGYDLLGQIGSLENHYLFKHKNHPRRSRRSAFHITKRLSDDDRVIWAEQQYEKERSKRSALRDSALNLFNDPMWNQQWYLQDTRMTAALPKLDLHVIPVWQKGITGKGVVITVLDDGLEWNHTDIYANYDPEASYDFNDNDHDPFPRYDPTNENKHGTRCAGEIAMQANNHKCGVGVAYNSKVGGIRMLDGIVTDAIEASSIGFNPGHVDIYSASWGPNDDGKTVEGPGRLAQKAFEYGVKQGRQGKGSIFVWASGNGGRQGDNCDCDGYTDSIYTISISSASQQGLSPWYAEKCSSTLATSYSSGDYTDQRITSADLHNDCTETHTGTSASAPLAAGIFALALEANPNLTWRDMQHLVVWTSEYDPLANNPGWKKNGAGLMVNSRFGFGLLNAKALVDLADPRTWRSVPEKKECVVKDNDFEPRALKANGEVIIEIPTRACEGQENAIKSLEHVQFEATIEYSRRGDLHVTLTSAAGTSTVLLAERERDTSPNGFKNWDFMSVHTWGENPIGTWTLRITDMSGRIQNEGRIVNWKLILHGTSSQPEHMKQPRVYTSYNTVQNDRRGVEKMVDPGEEQPTQENPKENTLVSKSPSSSSVGGRRDELEEGAPSQAMLRLLQSAFSKNSPPKQSPKKSPSAKLNIPYENFYEALEKLNKPSQLKDSEDSLYNDYVDVFYNTKPYKHRDDRLLQALVDILNEEN

SEQ ID NO: 568 - protein, 638 aa, Homo sapiens
MKGGCVSQWKAAAGFLFCVMVFASAERPVFTNHFLVELHKGGEDKARQVAAEHGFGVRKLPFAEGLYHFYHNGLAKAKRRRSLHHKQQLERDPRVKMALQQEGFDRKKRGYRDINEIDINMNDPLFTKQWYLINTGQADGTPGLDLNVAEAWELGYTGKGVTIGIMDDGIDYLHPDLASNYNAEASYDFSSNDPYPYPRYTDDWFNSHGTRCAGEVSAAANNNICGVGVAYNSKVAGIRMLDQPFMTDIIEASSISHMPQLIDIYSASWGPTDNGKTVDGPRELTLQAMADGVNKGRGGKGSIYVWASGDGGSYDDCNCDGYASSMWTISINSAINDGRTALYDESCSSTLASTFSNGRKRNPEAGVATTDLYGNCTLRHSGTSAAAPEAAGVFALALEANLGLTWRDMQHLTVLTSKRNQLHDEVHQWRRNGVGLEFNHLFGYGVLDAGAMVKMAKDWKTVPERFHCVGGSVQDPEKIPSTGKLVLTLTTDACEGKENFVRYLEHVQAVITVNATRRGDLNINMTSPMGTKSILLSRRPRDDDSKVGFDKWPFMTTHTWGEDARGTWTLELGFVGSAPQKGVLKEWTLMLHGTQSAPYIDQVVRDYQSKLAMSKKEELEEELDEAVERSLKSILNKN

SEQ ID NO: 569 - protein, 794 aa, Homo sapiens; identical to SEQ ID NO: 189

SEQ ID NO: 570 - protein, 715 aa, Homo sapiens
MELRPWLLWVVAATGTLVLLAADAQGQKVFTNTWAVRIPGGPAVANSVARKHGFLNLGQIFGDYYHFWHRGVTKRSLSPHRPRHSRLQREPQVQWLEQQVAKRRTKRDVYQEPTDPKFPQQWYLSGVTQRDLNVKAAWAQGYTGHGIVVSILDDGIEKNHPDLAGNYDPGASFDVNDQDPDPQPRYTQMNDNRHGTRCAGEVAAVANNGVCGVGVAYNARIGGVRMLDGEVTDAVEARSLGLNPNHIHIYSASWGPEDDGKTVDGPARLAEEAFFRGVSQGRGGLGSIFVWASGNGGREHDSCNCDGYTNSIYTLSISSATQFGNVPWYSEACSSTLATTYSSGNQNEKQIVTTDLRQKCTESHTGTSASAPLAAGIIALTLEANKNLTWRDMQHLVVQTSKPAHLNANDWATNGVGRKVSHSYGYGLLDAGAMVALAQNWTTVAPQRKCIIDILTEPKDIGKRLEVRKTVTACLGEPNHITRLEHAQARLTLSYNRRGDLAIHLVSPMGTRSTLLAARPHDYSADGFNDWAFMTTHSWDEDPSGEWVLEIENTSEANNYGTLTKFTLVLYGTAPEGLPVPPESSGCKTLTSSQACVVCEEGFSLHQKSCVQHCPPGFAPQVLDTHYSTENDVETIRASVCAPCHASCATCQGPALTDCLSCPSHASLDPVEQTCSRQSQSSRESPPQQQPPRLPPEVEAGQRLRAGLLPSHLPE

SEQ ID NO: 571 - protein, 755 aa, Homo sapiens
MRPAPIALWLRLVLALALVRPRAVGWAPVRAPIYVSSWAVQVSQGNREVERLARKFGFVNLGPIFPDGQYFHLRHRGVVQQSLTPHWGHRLHLKKNPKVQWFQQQTLQRRVKRSVVVPTDPWFSKQWYMNSEAQPDLSILQAWSQGLSGQGIVVSVLDDGIEKDHPDLWANYDPLASYDFNDYDPDPQPRYTPSKENRHGTRCAGEVAAMANNGFCGVGVAFNARIGGVRMLDGTITDVIEAQSLSLQPQHIHIYSASWGPEDDGRTVDGPGILTREAFRRGVTKGRGGLGTLFIWASGNGGLHYDNCNCDGYTNSIHTLSVGSTTQQGRVPWYSEACASTLTTTYSSGVATDPQIVTTDLHHGCTDQHTGTSASAPLAAGMIALALEANPFLTWRDMQHLVVRASKPAHLQAEDWRTNGVGRQVSHHYGYGLLDAGLLVDTARTWLPTQPQRKCAVRVQSRPTPILPLIYIRENVSACAGLHNSIRSLEHVQAQLTLSYSRRGDLEISLTSPMGTRSTLVAIRPLDVSTEGYNNWVFMSTHFWDENPQGVWTLGLENKGYYFNTGTLYRYTLLLYGTAEDMTARPTGPQVTSSACVQRDTEGLCQACDGPAYILGQLCLAYCPPRFFNHTRLVTAGPGHTAAPALRVCSSCHASCYTCRGGSPRDCTSCPPSSTLDQQQGSCMGPTTPDSRPRLRAAACPHHRCPASAMVLSLLAVTLGGPVLCGMSMDLPLYAWLSRARATPTKPQVWLPAGT

SEQ ID NO: 572 - protein, 1860 aa, Homo sapiens
MGWGSRCCCPGRLDLLCVLALLGGCLLPVCRTRVYTNHWAVKIAGGFPEANRIASKYGFINIGQIGALKDYYHFYHSRTIKRSVISSRGTHSFISMEPKVEWIQQQVVKKRTKRDYDFSRAQSTYFNDPKWPSMWYMHCSDNTHPCQSDMNIEGAWKRGYTGKNIVVTILDDGIERTHPDLMQNYDALASCDVNGNDLDPMPRYDASNENKHGTRCAGEVAAAANNSHCTVGIAFNAKIGGVRMLDGDVTDMVEAKSVSFNPQHVHIYSASWGPDDDGKTVDGPAPLTRQAFENGVRMGRRGLGSVFVWASGNGGRSKDHCSCDGYTNSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAMVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGPCDPECSEVGCDGPGPDHCNDCLHYYYKLKNNTRICVSSCPPGHYHADKKRCRKCAPNCESCFGSHGDQCMSCKYGYFLNEETNSCVTHCPDGSYQDTKKNLCRKCSENCKTCTEFHNCTECRDGLSLQGSRCSVSCEDGRYFNGQDCQPCHRFCATCAGAGADGCINCTEGYFMEDGRCVQSCSISYYFDHSSENGYKSCKKCDISCLTCNGPGFKNCTSCPSGYLLDLGMCQMGAICKDGEYVDEHGHCQTCEASCAKCQGPTQEDCTTCPMTRIFDDGRCVSNCPSWKFEFENQCHPCHHTCQRCQGSGPTHCTSCGADNYGREHFLYQGECGDSCPEGHYATEGNTCLPCPDNCELCHSVHVCTRCMKGYFIAPTNHTCQKLECGQGEVQDPDYEECVPCEEGCLGCSLDDPGTCTSCAMGYYRFDHHCYKTCPEKTYSEEVECKACDSNCGSCDQNGCYWCEEGFFLLGGSCVRKCGPGFYGDQEMGECESCHRACETCTGPGHDECSSCQEGLQLLRGMCVHATKTQEEGKFWNDILRKLQPCHSSCKTCNGSATLCTSCPKGAYLLAQACVSSCPQGTWPSVRSGSCENCTEACAICSGADLCKKCQMQPGHPLFLHEGRCYSKCPEGSYAEDGICERCSSPCRTCEGNATNCHSCEGGHVLHHGVCQENCPERHVAVKGVCKHCPEMCQDCIHEKTCKECTPEFFLHDDMCHQSCPRGFYADSRHCVPCHKDCLECSGPKADDCELCLESSWVLYDGLCLEECPAGTYYEKETKECRDCHKSCLTCSSSGTCTTCQKGLIMNPRGSCMANEKCSPSEYWDEDAPGCKPCHVKCFHCMGPAEDQCQTCPMNSLLLNTTCVKDCPEGYYADEDSNRCAHCHSSCRTCEGRHSRQCHSCRPGWFQLGKECLLQCREGYYADNSTGRCERCNRSCKGCQGPRPTDCLSCDRFFFLLRSKGECHRSCPDHYYVEQSTQTCERCHPTCDQCKGKGALNCLSCVWSYHLMGGICTSDCLVGEYRVGEGEKFNCEKCHESCMECKGPGAKNCTLCPANLVLHMDDSHCLHCCNTSDPPSAQECCDCQDTTDECILRTSKVRPATEHFKTALFITSSMMLVLLLGAAVVVWKKSRGRVQPAAKAGYEKLADPNKSYSSYKSSYRESTSFEEDQVIEYRDRDYDEDDDDDIVYMGQDGTVYRKFKYGLLDDDDIDELEYDDESYSYYQ

SEQ ID NO: 573 - protein, 969 aa, Homo sapiens
MPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGKLKEWSLILYGTAEHPYHTFSAHQSRSRMLELSAPELEPPKAALSPSQVEVPEDEEDYTAQSTPGSANILQTSVCHPECGDKGCDGPNADQCLNCVHFSLGSVKTSRKCVSVCPLGYFGDTAARRCRRCHKGCETCSSRAATQCLSCRRGFYHHQEMNTCVTLCPAGFYADESQKNCLKCHPSCKKCVDEPEKCTVCKEGFSLARGSCIPDCEPGTYFDSELIRCGECHHTCGTCVGPGREECIHCAKNFHFHDWKCVPACGEGFYPEEMPGLPHKVCRRCDENCLSCAGSSRNCSRCKTGFTQLGTSCITNHTCSNADETFCEMVKSNRLCERKLFIQFCCRTCLLAG

SEQ ID NO: 574 - protein, 785 aa, Homo sapiens
MPKGRQKVPHLDAPLGLPTCLWLELAGLFLLVPWVMGLAGTGGPDGQGTGGPSWAVHLESLEGDGEEETLEQQADALAQAAGLVNAGRIGELQGHYLFVQPAGHRPALEVEAIRQQVEAVLAGHEAVRWHSEQRLLRRAKRSVHFNDPKYPQQWHLNNRRSPGRDINVTGVWERNVTGRGVTVVVVDDGVEHTIQDIAPNYSPEGSYDLNSNDPDPMPHPDVENGNHHGTRCAGEIAAVPNNSFCAVGVAYGSRIAGIRVLDGPLTDSMEAVAFNKHYQINDIYSCSWGPDDDGKTVDGPHQLGKAALQHGVIAGRQGFGSIFVVASGNGGQHNDNCNYDGYANSIYTVTIGAVDEEGRMPFYAEECASMLAVTFSGGDKMLRSIVTTDWDLQKGTGCTEGHTGTSAAAPLAAGMIALMLQVRPCLTWRDVQHIIVFTATRYEDRRAEWVTNEAGFSHSHQHGFGLLNAWRLVNAAKIWTSVPYLASYVSPVLKENKAIPQSPRSLEVLWNVSRMDLEMSGLKTLEHVAVTVSITHPRRGSLELKLFCPSGMMSLIGAPRSMDSDPNGFNDWTFSTVRCWGERARGTYRLVIRDVGDESFQVGILRQWQLTLYGSVWSAVDIRDRQRLLESAMSGKYLHDDFALPCPPGLKIPEEDGYTITPNTLKTLVLVGCFTVFWTVYYMLEVYLSQRNVASNQVCRSGPCHWPHRSRKAKEEGTELESVPLCSSKDPDEVETESRGPPTTSDLLAPDLLEQGDWSLSQNKSALDCPHQHLDVPHGKEEQIC

SEQ ID NO: 575 - protein, 1052 aa, Homo sapiens
MKLVNIWLLLLVVLLCGKKHLGDRLEKKSFEKAPCPGCSHLTLKVEFSSTVVEYEYIVAFNGYFTAKARNSFISSALKSSEVDNWRIIPRNNPSSDYPSDFEVIQIKEKQKAGLLTLEDHPNIKRVTPQRKVFRSLKYAESDPTVPCNETRWSQKWQSSRPLRRASLSLGSGFWHATGRHSSRRLLRAIPRQVAQTLQADVLWQMGYTGANVRVAVFDTGLSEKHPHFKNVKERTNWTNERTLDDGLGHGTFVAGVIASMRECQGFAPDAELHIFRVFTNNQVSYTSWFLDAFNYAILKKIDVLNLSIGGPDFMDHPFVDKVWELTANNVIMVSAIGNDGPLYGTLNNPADQMDVIGVGGIDFEDNIARFSSRGMTTWELPGGYGRMKPDIVTYGAGVRGSGVKGGCRALSGTSVASPVVAGAVTLLVSTVQKRELVNPASMKQALIASARRLPGVNMFEQGHGKLDLLRAYQILNSYKPQASLSPSYIDLTECPYMWPYCSQPIYYGGMPTVVNVTILNGMGVTGRIVDKPDWQPYLPQNGDNIEVAFSYSSVLWPWSGYLAISISVTKKAASWEGIAQGHVMITVASPAETESKNGAEQTSTVKLPIKVKIIPTPPRSKRVLWDQYHNLRYPPGYFPRDNLRMKNDPLDWNGDHIHTNFRDMYQHLRSMGYFVEVLGAPFTCFDASQYGTLLMVDSEEEYFPEEIAKLRRDVDNGLSLVIFSDWYNTSVMRKVKFYDENTRQWWMPDTGGANIPALNELLSVWNMGFSDGLYEGEFTLANHDMYYASGCSIAKFPEDGVVITQTFKDQGLEVLKQETAVVENVPILGLYQIPAEGGGRIVLYGDSNCLDDSHRQKDCFWLLDALLQYTSYGVTPPSLSHSGNRQRPPSGAGSVTPERMEGNHLHRYSKVLEAHLGDPKPRPLPACPRLSWAKPQPLNETAPSNLWKHQKLLSIDLDKVVLPNFRSNRPQVRPLSPGESGAWDIPGGIMPGRYNQEVGQTIPVFAFLGAMVVLAFFVVQINKAKSRPKRRKPRVKRPQLMQQVHPPKTPSV

SEQ ID NO: 576 - protein, 692 aa, Homo sapiens
MGTVSSRRSWWPLPLLLLLLLLLGPAGARAQEDEDGDYEELVLALRSEEDGLAEAPEHGTTATFHRCAKDPWRLPGTYVVVLKEETHLSQSERTARRLQAQAARRGYLTKILHVFHGLLPGFLVKMSGDLLELALKLPHVDYIEEDSSVFAQSIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVAALPPSTHGAGWQLFCRTVWSAHSGPTRMATAVARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEGAVTAVAICCRSRHLAQASQELQ

SEQ ID NO: 577 - protein, 519 aa, Homo sapiens
MIPVSLVVVVVGGWTVVYLTDLVLKSSVYFKHSYEDWLENNGLSISPFHIRWQTAVFNRAFYSWGRRKARMLYQWFNFGMVFGVIAMFSSFFLLGKTLMQTLAQMMADSPSSYSSSSSSSSSSSSSSSSSSSSSSSLHNEQVLQVVVPGINLPVNQLTYFFTAVLISGVVHEIGHGIAAIREQVRFNGFGIFLFIIYPGAFVDLFTTHLQLISPVQQLRIFCAGIWHNFVLALLGILALVLLPVILLPFYYTGVGVLITEVAEDSPAIGPRGLFVGDLVTHLQDCPVTNVQDWNECLDTIAYEPQIGYCISASTLQQLSFPVRAYKRLDGSTECCNNHSLTDVCFSYRNNFNKRLHTCLPARKAVEATQVCRTNKDCKKSSSSSFCIIPSLETHTRLIKVKHPPQIDMLYVGHPLHLHYTVSITSFIPRFNFLSIDLPVVVETFVKYLISLSGALAIVNAVPCFALDGQWILNSFLDATLTSVIGDNDVKDLIGFFILLGGSVLLAANVTLGLWMVTAR

SEQ ID NO: 578 - protein, 476 aa, Homo sapiens
MAGRGGSALLALCGALAACGWLLGAEAQEPGAPAAGMRRRRRLQQEDGISFEYHRYPELREALVSVWLQCTAISRIYTVGRSFEGRELLVIELSDNPGVHEPGEPEFKYIGNMHGNEAVGRELLIFLAQYLCNEYQKGNETIVNLIHSTRIHIMPSLNPDGFEKAASQPGELKDWFVGRSNAQGIDLNRNFPDLDRIVYVNEKEGGPNNHLLKNMKKIVDQNTKLAPETKAVIHWIMDIPFVLSANLHGGDLVANYPYDETRSGSAHEYSSSPDDAIFQSLARAYSSFNPAMSDPNRPPCRKNDDDSSFVDGTTNGGAWYSVPGGMQDFNYLSSNCFEITVELSCEKFPPEETLKTYWEDNKNSLISYLEQIHRGVKGFVRDLQGNPIANATISVEGIDHDVTSAKDGDYWRLLIPGNYKLTASAPGYLAITKKVAVPYSPAAGVDFELESFSERKEEEKEELMEWWKMMSETLNF

SEQ ID NO: 579 - protein, 431 aa, Homo sapiens
MHVRSLRAAAPHSFVALWAPLFLLRSALADFSLDNEVHSSFIHRRLRSQERREMQREILSILGLPHRPRPHLQGKHNSAPMFMLDLYNAMAVEEGGGPGGQGFSYPYKAVFSTQGPPLASLQDSHFLTDADMVMSFVNLVEHDKEFFHPRYHHREFRFDLSKIPEGEAVTAAEFRIYKDYIRERFDNETFRISVYQVLQEHLGRESDLFLLDSRTLWASEEGWLVFDITATSNHWVVNPRHNLGLQLSVETLDGQSINPKLAGLIGRHGPQNKQPFMVAFFKATEVHFRSIRSTGSKQRSQNRSKTPKNQEALRMANVAENSSSDQRQACKKHELYVSFRDLGWQDWIIAPEGYAANYCEGECAFPLNSHMNATNHAIVQTLVHFINPETVPKPCCAPTQLNAISVLYFDDSSNVILKKYRNMVVEACGCH

SEQ ID NO: 580 - protein, 431 aa, Homo sapiens
MHVRSLRAAAPHSFVALWAPLFLLRSALADFSLDNEVHSSFIHRRLRSQERREMQREILSILGLPHRPRPHLQGKHNSAPMFMLDLYNAMAVEEGGGPGGQGFSYPYKAVFSTQGPPLASLQDSHFLTDADMVMSFVNLVEHDKEFFHPRYHHREFRFDLSKIPEGEAVTAAEFRIYKDYIRERFDNETFRISVYQVLQEHLGRESDLFLLDSRTLWASEEGWLVFDITATSNHWVVNPRHNLGLQLSVETLDGQSINPKLAGLIGRHGPQNKQPFMVAFFKATEVHFRSIRSTGSKQRSQNRSKTPKNQEALRMANVAENSSSDQRQACSKHELYVSFRDLGWQDWIIAPEGYAAYYCEGECAFPLNSYMNATNHAIVQTLVHFINPETVPKPCCAPTQLNAISVLYFDDDSNVILKKYRNMVVEACGCH

SEQ ID NO: 581 - protein, 431 aa, Homo sapiens
MHVRSLRAAAPHSFVALWAPLFLLRSALADFSLDNEVHSSFIHRRLRSQERREMQREILSILGLPHRPRPHLQGKHNSAPMFMLDLYNAMAVEEGGGPGGQGFSYPYKAVFSTQGPPLASLQDSHFLTDADMVMSFVNLVEHDKEFFHPRYHHREFRFDLSKIPEGEAVTAAEFRIYKDYIRERFDNETFRISVYQVLQEHLGRESDLFLLDSRTLWASEEGWLVFDITATSNHWVVNPRHNLGLQLSVETLDGQSINPKLAGLIGRHGPQNKQPFMVAFFKATEVHFRSIRSTGSKQRSQNRSKTPKNQEALRMANVAENSSSDQRQACSKHELYVSFRDLGWQDWIIAPEGYAAYYCEGECAFPLNSYMNATNHAIVQTLVHSINPETVPKPCCAPTQLNAISVLYFDDDSNVILKKYRNMVVRACGCH

SEQ ID NO: 582-583 - skipped (2 entries)

SEQ ID NO: 584 - DNA, 646 bp, Artificial sequence
  Synthetic sequence
atgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaag

SEQ ID NO: 585 - DNA, 815 bp, Artificial sequence
  Synthetic sequence
gagagagccctggaggcagacgtggagtgacgatgctcttccctgttctgagttgtgggtgcacctgagcagggggagaggcgcttgtcaggaagatggacagaggggagccagccccatcagccaaagccttgaggaggagcaaggcctatgtgacagggagggagaggatgtgcagggccagggccgtccagggggagtgagcgcttcctgggaggtgtccacgtgagccttgctcgaggcctgggatcagccttacaacgtgtctctgcttctctcccctccaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggtccctgcctgcatgtgactgtaaatccctcccatgttttctctgagtctccctttgcctgctgaggctgtatgtgggctccaggtaacagtgctgtcttcgggccccctgaactgtgttcatggagcatctggctgggtaggcacatgctgggcttgaatccaggggggactgaatcctcagcttacggacctgggcccatctgtttctggagggctccagtcttccttgtcctgtcttggagtccccaagaaggaatca

SEQ ID NO: 586-628 - skipped (43 entries)

SEQ ID NO: 629 - protein, 18 aa, Artificial Sequence
  Synthetic sequence
  misc_feature (4)..(4): X at this position appears as "v" for SEQ ID NO: 629 in the Specification filed herewith.  This position is selected from Q, D or E.
  MISC_FEATURE (11)..(11): X at this position appears as "w" for SEQ ID NO: 629 in the Specification filed herewith.  This position is selected from S or N.
  MISC_FEATURE (12)..(12): X at this position appears as "x" for SEQ ID NO: 629 in the Specification filed herewith.  This position is selected from H, N, or I.
  MISC_FEATURE (13)..(13): X at this position appears as "y" for SEQ ID NO: 629 in the Specification filed herewith.  This position is selected from D, A, I, N, G, H, K, S, or null.
  MISC_FEATURE (14)..(14): X at this position appears as "z" for SEQ ID NO: 629 in the Specification filed herewith.  This position is selected from GGKQALETVQRLLPVLCQD (SEQ ID NO: 630) or GGKQALETVQRLLPVLCQA (SEQ ID NO: 631).
LTPXQVVAIAXXXXGHGG

SEQ ID NO: 630 - protein, 19 aa, Artificial Sequence
  Synthetic sequence
GGKQALETVQRLLPVLCQD

SEQ ID NO: 631 - protein, 19 aa, Artificial Sequence
  Synthetic sequence
GGKQALETVQRLLPVLCQA

SEQ ID NO: 632 - protein, 196 aa, Homo sapiens; identical to SEQ ID NO: 53

SEQ ID NO: 633-636 - skipped (4 entries)

SEQ ID NO: 637 - DNA, 444 bp, Homo sapiens
atggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctgggaaaaccagtgagtctggagagctgcatgggctcacaactgaggaggaatttgtagaagggatatacaaagtggaaatagacaccaaatcttactggaaggcacttggcatctccccattccatgagcatgcagaggtggtattcacagccaacgactccggcccccgccgctacaccattgccgccctgctgagcccctactcctattccaccacggctgtcgtcaccaatcccaaggaatga

SEQ ID NO: 638 - protein, 147 aa, Homo sapiens
MASHRLLLLCLAGLVFVSEAGPTGTGESKCPLMVKVLDAVRGSPAINVAVHVFRKAADDTWEPFASGKTSESGELHGLTTEEEFVEGIYKVEIDTKSYWKALGISPFHEHAEVVFTANDSGPRRYTIAALLSPYSYSTTAVVTNPKE

SEQ ID NO: 639-783 - skipped (145 entries)

SEQ ID NO: 784 - protein, 134 aa, Homo sapiens
MKSVLLLTTLLVPAHLVAAWSNNYAVDCPQHCDSSECKSSPRCKRTVLDDCGCCRVCAAGRGETCYRTVSGMDGMKCGPGLRCQPSNGEDPFGEEFGICKEHDMASGDGNIVREEVVKENAAGSPVMRKWLNPR

SEQ ID NO: 785 - protein, 184 aa, Homo sapiens
MKSVLLLTTLLVPAHLVAAWSNNYAVDCPQHCDSSECKSSPRCKRTVLDDCGCCRVCAAGRGETCYRTVSGMDGMKCGPGLRCQPSNGEDPFGEEFGICKDCPYGTFGMDCRETCNCQSGICDRGTGKCLKFPFFQYSVTKSSNRFVSLTEHDMASGDGNIVREEVVKENAAGSPVMRKWLNPR

SEQ ID NO: 786-809 - skipped (24 entries)

SEQ ID NO: 810 - DNA, 87 bp, Homo sapiens
gacagtgcagtcacccataaagtagaaagcactactaacagcactggagggtgtagtgtttcctactttatggatgagtgtactgtg

SEQ ID NO: 811 - DNA, 23 bp, Homo sapiens
tccataaagtaggaaacactaca

SEQ ID NO: 812 - DNA, 106 bp, Homo sapiens
tccataaagtaggaaacactacacgattccataaagtaggaaacactacaacgcgttccataaagtaggaaacactacatcactccataaagtaggaaacactaca

SEQ ID NO: 813 - DNA, 591 bp, Homo sapiens
atcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctg

SEQ ID NO: 814 - DNA, 591 bp, Homo sapiens
atcaacctctggattacaaaatttgtgaaagattgactgatattcttaactatgttgctccttttacgctgtgtggatatgctgctttaatgcctctgtatcatgctattgcttcccgtacggctttcgttttctcctccttgtataaatcctggttgctgtctctttatgaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcggggaagctgacgtcctttccatggctgctcgcctgtgttgccaactggatcctgcgcgggacgtccttctgctacgtcccttcggctctcaatccagcggacctcccttcccgaggccttctgccggttctgcggcctctcccgcgtcttcgctttcggcctccgacgagtcggatctccctttgggccgcctccccgcctg

SEQ ID NO: 815 - DNA, 591 bp, Homo sapiens
atcaacctctggattacaaaatttgtgaaagattgactgatattcttaactatgttgctccttttacgctgtgtggatatgctgctttaatgcctctgtatcatgctattgcttcccgtacggctttcgttttctcctccttgtataaatcctggttgctgtctctttatgaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcggggaagctgacgtcctttccttggctgctcgcctgtgttgccaactggatcctgcgcgggacgtccttctgctacgtcccttcggctctcaatccagcggacctcccttcccgaggccttctgccggttctgcggcctctcccgcgtcttcgctttcggcctccgacgagtcggatctccctttgggccgcctccccgcctg

SEQ ID NO: 816 - DNA, 591 bp, Homo sapiens
atcaacctctggattacaaaatttgtgaaagattgactgatattcttaactatgttgctccttttacgctgtgtggatatgctgctttaatgcctctgtatcatgctattgcttcccgtacggctttcgttttctcctccttgtataaatcctggttgctgtctctttatgaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcggggaagctgacgtcctttccttggctgctcgcctgtgttgccaactggatcctgcgcgggacgtccttctgctacgtcccttcggctctcaatccagcggacctcccttcccgaggccttctgccggttctgcggcctctcccgcctcttcgctttcggcctccgacgagtcggatctccctttgggccgcctccccgcctg

SEQ ID NO: 817 - DNA, 591 bp, Homo sapiens
atcaacctctggattacaaaatttgtgaaagattgactgatattcttaactatgttgctccttttacgctgtgtggatatgctgctttaatgcctctgtatcatgctattgcttcccgtacggctttcgttttctcctccttgtataaatcctggttgctgtctctttatgaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcggggaagctgacgtcctttccttggctgctcgcctgtgttgccaactggatcctgcgcgggacgtccttctgctacgtcccttcggctctcaatccagcggacctcccttcccgaggccttctgccggttctgcggcctctcccgcgtgttcgctttcggcctccgacgagtcggatctccctttgggccgcctccccgcctg

SEQ ID NO: 818 - DNA, 591 bp, Homo sapiens
atcaacctctggattacaaaatttgtgaaagattgactgatattcttaactatgttgctccttttacgctgtgtggatatgctgctttaatgcctctgtatcatgctattgcttcccgtacggctttcgttttctcctccttgtataaatcctggttgctgtctctttatgaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcggggaagctgacgtcctttccttggctgctcgcctgtgttgccaactggatcctgcgcgggacgtccttctgctacgtcccttcggctctcaatccagcggacctcccttcccgaggccttctgccggttctgcggcctctcccgcgtctacgctttcggcctccgacgagtcggatctccctttgggccgcctccccgcctg

SEQ ID NO: 819 - protein, 15 aa, Artificial Sequence
  Synthetic Sequence
  MISC_FEATURE (4)..(4): X at this position appears as "v" for SEQ ID NO: 819 in the Specification filed herewith.  This position is selected from A, C, D, E, F, G, H, I, K, L, M, N, P, Q, R, S, T, V, W, Y and null.
  MISC_FEATURE (11)..(11): X at this position appears as "w" for SEQ ID NO: 819 in the Specification filed herewith.  This position is selected from A, C, D, E, F, G, H, I, K, L, M, N, P, Q, R, S, T, V, W, Y and null.
  MISC_FEATURE (12)..(12): X at this position appears as "x" for SEQ ID NO: 819 in the Specification filed herewith.  This position is selected from A, C, D, E, F, G, H, I, K, L, M, N, P, Q, R, S, T, V, W, Y and null.
  MISC_FEATURE (13)..(13): X at this position appears as "y" for SEQ ID NO: 819 in the Specification filed herewith.  This position is selected from A, C, D, E, F, G, H, I, K, L, M, N, P, Q, R, S, T, V, W, Y and null.
  MISC_FEATURE (14)..(14): X at this position appears as "z" for SEQ ID NO: 819 in the Specification filed herewith.  This position is selected from any one of SEQ ID NO: 820, SEQ ID NO: 821, SEQ ID NO: 630, SEQ ID NO: 631, SEQ ID NO: 824, and SEQ ID NO: 825.
  MISC_FEATURE (15)..(15): X at this position appears as "a" (alpha) for SEQ ID NO: 819 in the Specification filed herewith.  This position is any four consecutive amino acids or null.
LTPXQVVAIAXXXXX

SEQ ID NO: 820 - protein, 7 aa, Artificial Sequence
  Synthetic Sequence
GGRPALE

SEQ ID NO: 821 - protein, 7 aa, Artificial Sequence
  Synthetic Sequence
GGKQALE

SEQ ID NO: 822-823 - skipped (2 entries)

SEQ ID NO: 824 - protein, 18 aa, Artificial Sequence
  Synthetic Sequence
GKQALETVQRLLPVLCQD

SEQ ID NO: 825 - protein, 18 aa, Artificial Sequence
  Synthetic Sequence
GKQALETVQRLLPVLCQA

SEQ ID NO: 826-827 - skipped (2 entries)

SEQ ID NO: 828 - protein, 4 aa, Artificial Sequence
  Synthetic Sequence
GHGG

SEQ ID NO: 829 - protein, 4 aa, Artificial Sequence
  Synthetic Sequence
HGSG

SEQ ID NO: 830 - protein, 4 aa, Artificial Sequence
  Synthetic Sequence
HGGG

SEQ ID NO: 831 - protein, 4 aa, Artificial Sequence
  Synthetic Sequence
GGHD

SEQ ID NO: 832 - protein, 4 aa, Artificial Sequence
  Synthetic Sequence
GAHD

SEQ ID NO: 833 - protein, 4 aa, Artificial Sequence
  Synthetic Sequence
AHDG

SEQ ID NO: 834 - protein, 4 aa, Artificial Sequence
  Synthetic Sequence
PHDG

SEQ ID NO: 835 - protein, 4 aa, Artificial Sequence
  Synthetic Sequence
GPHD

SEQ ID NO: 836 - protein, 4 aa, Artificial Sequence
  Synthetic Sequence
GHGP

SEQ ID NO: 837 - protein, 4 aa, Artificial Sequence
  Synthetic Sequence
PHGG

SEQ ID NO: 838 - protein, 4 aa, Artificial Sequence
  Synthetic Sequence
PHGP

SEQ ID NO: 839 - protein, 4 aa, Artificial Sequence
  Synthetic Sequence
AHGA

SEQ ID NO: 840 - protein, 4 aa, Artificial Sequence
  Synthetic Sequence
LHGA

SEQ ID NO: 841 - protein, 4 aa, Artificial Sequence
  Synthetic Sequence
VHGA

SEQ ID NO: 842 - protein, 4 aa, Artificial Sequence
  Synthetic Sequence
IVHG

SEQ ID NO: 843 - protein, 4 aa, Artificial Sequence
  Synthetic Sequence
IHGM

SEQ ID NO: 844 - skipped

SEQ ID NO: 845 - protein, 4 aa, Artificial Sequence
  Synthetic Sequence
RDHG

SEQ ID NO: 846 - protein, 4 aa, Artificial Sequence
  Synthetic Sequence
RHGE

SEQ ID NO: 847 - protein, 4 aa, Artificial Sequence
  Synthetic Sequence
HRGE

SEQ ID NO: 848 - protein, 4 aa, Artificial Sequence
  Synthetic Sequence
RHGD

SEQ ID NO: 849 - protein, 4 aa, Artificial Sequence
  Synthetic Sequence
HRGD

SEQ ID NO: 850 - protein, 4 aa, Artificial Sequence
  Synthetic Sequence
GPYE

SEQ ID NO: 851 - protein, 4 aa, Artificial Sequence
  Synthetic Sequence
NHGG

SEQ ID NO: 852 - protein, 4 aa, Artificial Sequence
  Synthetic Sequence
THGG

SEQ ID NO: 853 - protein, 4 aa, Artificial Sequence
  Synthetic Sequence
GTHG

SEQ ID NO: 854 - protein, 4 aa, Artificial Sequence
  Synthetic Sequence
GSGS

SEQ ID NO: 855 - protein, 4 aa, Artificial Sequence
  Synthetic Sequence
GSGG

SEQ ID NO: 856 - protein, 4 aa, Artificial Sequence
  Synthetic Sequence
GGGG

SEQ ID NO: 857 - protein, 4 aa, Artificial Sequence
  Synthetic Sequence
GRGG

SEQ ID NO: 858 - protein, 4 aa, Artificial Sequence
  Synthetic Sequence
GKGG

SEQ ID NO: 859 - protein, 460 aa, Homo sapiens
MFTIKLLLFIVPLVISSRIDQDNSSFDSLSPEPKSRFAMLDDVKILANGLLQLGHGLKDFVHKTKGQINDIFQKLNIFDQSFYDLSLQTSEIKEEEKELRRTTYKLQVKNEEVKNMSLELNSKLESLLEEKILLQQKVKYLEEQLTNLIQNQPETPEHPEVTSLKTFVEKQDNSIKDLLQTVEDQYKQLNQQHSQIKEIENQLRRTSIQEPTEISLSSKPRAPRTTPFLQLNEIRNVKHDGIPAECTTIYNRGEHTSGMYAIRPSNSQVFHVYCDVISGSPWTLIQHRIDGSQNFNETWENYKYGFGRLDGEFWLGLEKIYSIVKQSNYVLRIELEDWKDNKHYIEYSFYLGNHETNYTLHLVAITGNVPNAIPENKDLVFSTWDHKAKGHFNCPEGYSGGWWWHDECGENNLNGKYNKPRAKSKPERRRGLSWKSQNGRLYSIKSTKMLIHPTDSESFE

SEQ ID NO: 860 - RNA, 16 nt, Artificial Sequence
  Synthetic Sequence
  MISC_FEATURE (10)..(10): n is a, c, g, or u.
agyyyuuyunarrrca

SEQ ID NO: 861 - RNA, 18 nt, Artificial Sequence
  Synthetic Sequence
mggcycuuuumagrgcca

SEQ ID NO: 862 - RNA, 18 nt, Artificial Sequence
  Synthetic Sequence
aggyyyuhhuharrrcca

What is claimed is:

1. A compound of Formula (V)

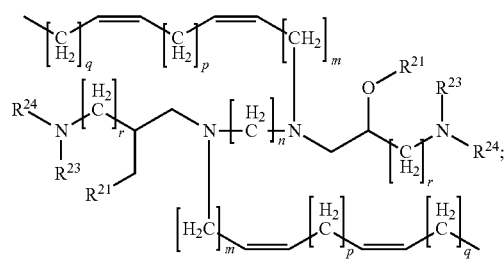

wherein $R^{21}$, $R^{23}$, and $R^{24}$ are independently selected from hydrogen, $C_{1-6}$ alkyl, $C_{1-6}$ haloalkyl, $C_{1-6}$ hydroxyalkyl, $C_{1-6}$ alkoxyalkyl, $C_{5-10}$ aryl, 5- to 10-membered heteroaryl, or $C_{3-6}$ cycloalkyl;

n is an integer from 1 to 20;

m is 6, 7, 8, 9, or 10;

p is 1, 2, 3, or 4;

q is 1, 2, 3, 4, or 5; and r is 1, 2, 3, 4, 5, or 6.

2. The compound of claim 1, wherein $R^{21}$, $R^{23}$, and $R^{24}$ are hydrogen.

3. The compound of claim 1, wherein n is 16, 17, 18, 19, or 20.

4. The compound of claim 3, wherein:

q is 4;

p is 1; and r is 1.

5. The compound of claim 3, wherein m is 8.

6. A pharmaceutical composition comprising a compound of claim 1 and a pharmaceutically acceptable carrier or excipient.

7. A lipid aggregate comprising a compound of claim 1.

8. The lipid aggregate of claim 7, wherein the lipid aggregate does not comprise one or more additional lipids or polymers.

9. The lipid aggregate of claim 7 further comprising a nucleic acid, selected from a DNA molecule or an RNA molecule.

10. The compound of claim 1, wherein n is 1, 2, 3, 4, 5, 6, 7, 8, 9, 10, 11, 12, 13, 14, or 15.

11. The compound of claim 1, wherein n is 4.

* * * * *